(12) United States Patent
Bramucci et al.

(10) Patent No.: US 9,273,330 B2
(45) Date of Patent: Mar. 1, 2016

(54) BUTANOL TOLERANCE IN MICROORGANISMS

(71) Applicant: Butamax Advanced Biofuels LLC, Wilmington, DE (US)

(72) Inventors: Michael G. Bramucci, Boothwyn, PA (US); Vasantha Nagarajan, Wilmington, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 2 days.

(21) Appl. No.: 14/045,506

(22) Filed: Oct. 3, 2013

(65) Prior Publication Data

US 2014/0096439 A1    Apr. 10, 2014

Related U.S. Application Data

(60) Provisional application No. 61/709,178, filed on Oct. 3, 2012, provisional application No. 61/846,771, filed on Jul. 16, 2013.

(51) Int. Cl.
| | |
|---|---|
| *C10L 1/18* | (2006.01) |
| *C12P 7/04* | (2006.01) |
| *C12P 7/16* | (2006.01) |
| *C12N 1/00* | (2006.01) |
| *C12N 9/88* | (2006.01) |

(52) U.S. Cl.
CPC ... *C12P 7/16* (2013.01); *C12N 9/88* (2013.01); *C12P 7/04* (2013.01); *C12Y 401/01001* (2013.01); *C12Y 406/01001* (2013.01); *Y02E 50/10* (2013.01)

(58) Field of Classification Search
CPC ............. C12P 7/16; C12P 7/04; Y02E 50/10; C12Y 406/01001; C12Y 401/01001; C12N 9/88
USPC ............ 44/451; 435/157, 160, 254.2, 254.21, 435/254.22, 254.23
See application file for complete search history.

(56) References Cited

U.S. PATENT DOCUMENTS

| | | | |
|---|---|---|---|
| 4,683,202 A | 7/1987 | Mullis | |
| 5,686,276 A | 11/1997 | Laffend et al. | |
| 6,432,688 B1 | 8/2002 | Ito et al. | |
| 6,634,473 B1 | 10/2003 | Wagner | |
| 6,949,356 B1 * | 9/2005 | Busby et al. | 435/41 |
| 7,541,173 B2 | 6/2009 | Bramucci et al. | |
| 7,851,188 B2 | 12/2010 | Donaldson et al. | |
| 7,910,342 B2 | 3/2011 | Liao et al. | |
| 7,993,889 B1 | 8/2011 | Donaldson et al. | |
| 8,017,364 B2 | 9/2011 | Bramucci et al. | |
| 8,101,808 B2 | 1/2012 | Evanko et al. | |
| 8,129,162 B2 | 3/2012 | Li et al. | |
| 8,178,328 B2 | 5/2012 | Donaldson et al. | |
| 8,188,250 B2 | 5/2012 | Bramucci et al. | |
| 8,206,970 B2 | 6/2012 | Eliot et al. | |
| 8,222,017 B2 | 7/2012 | Li et al. | |
| 8,241,878 B2 | 8/2012 | Anthony et al. | |
| 8,273,558 B2 | 9/2012 | Donaldson et al. | |
| 8,283,144 B2 | 10/2012 | Donaldson et al. | |
| 8,372,612 B2 | 2/2013 | Larossa et al. | |
| 8,389,252 B2 | 3/2013 | Larossa | |
| 8,455,224 B2 | 6/2013 | Paul | |
| 8,455,225 B2 | 6/2013 | Bramucci et al. | |
| 8,465,964 B2 | 6/2013 | Anthony | |
| 8,518,678 B2 | 8/2013 | Flint et al. | |
| 8,557,562 B2 | 10/2013 | Bramucci et al. | |
| 8,614,085 B2 | 12/2013 | Van Dyk | |
| 8,637,281 B2 | 1/2014 | Paul et al. | |
| 8,637,289 B2 | 1/2014 | Anthony et al. | |
| 8,652,823 B2 | 2/2014 | Flint et al. | |
| 8,669,094 B2 | 3/2014 | Anthony et al. | |
| 8,691,540 B2 | 4/2014 | Bramucci et al. | |
| 8,735,114 B2 | 5/2014 | Donaldson et al. | |
| 8,765,433 B2 | 7/2014 | Satagopan et al. | |
| 8,785,166 B2 | 7/2014 | Anthony | |
| 8,795,992 B2 | 8/2014 | Bramucci et al. | |
| 8,828,694 B2 | 9/2014 | Anthony et al. | |
| 8,828,704 B2 | 9/2014 | Donaldson et al. | |
| 8,871,488 B2 | 10/2014 | Dauner et al. | |
| 8,889,385 B2 | 11/2014 | Donaldson et al. | |
| 8,895,307 B2 | 11/2014 | Li et al. | |
| 8,906,666 B2 | 12/2014 | Alsaker | |
| 8,911,981 B2 | 12/2014 | Li et al. | |
| 8,940,511 B2 | 1/2015 | Larossa | |
| 8,945,859 B2 | 2/2015 | Donaldson et al. | |
| 8,945,899 B2 | 2/2015 | Li et al. | |
| 8,951,774 B2 | 2/2015 | Donaldson | |
| 8,951,937 B2 | 2/2015 | Flint et al. | |
| 8,956,850 B2 | 2/2015 | Anthony | |
| 8,962,298 B2 | 2/2015 | Donaldson et al. | |
| 8,969,065 B2 | 3/2015 | Anthony et al. | |

(Continued)

OTHER PUBLICATIONS

Broun et al., Catalytic plasticity of fatty acid modification enzymes underlying chemical diversity of plant lipids. Science, 1998, vol. 282: 1315-1317.*

Chica et al., Semi-rational approaches to engineering enzyme activity: combining the benefits of directed evolution and rational design. Curr. Opi. Biotechnol., 2005, vol. 16: 378-384.*

Devos et al., Practical limits of function prediction. Proteins: Structure, Function, and Genetics. 2000, vol. 41: 98-107.*

Kisselev L., Polypeptide release factors in prokaryotes and eukaryotes: same function, different structure. Structure, 2002, vol. 10: 8-9.*

Seffernick et al., Melamine deaminase and Atrazine chlorohydrolase: 98 percent identical but functionally different. J. Bacteriol., 2001, vol. 183 (8): 2405-2410.*

(Continued)

*Primary Examiner* — Ganapathirama Raghu

(57) ABSTRACT

Provided herein are recombinant yeast host cells and methods for their use for production of fermentation products from a pyruvate utilizing pathway. Yeast host cells provided herein comprise reduced pyruvate decarboxylase activity and modified adenylate cyclase activity. In embodiments, yeast host cells provided herein comprise resistance to butanol and increased biomass production.

12 Claims, 9 Drawing Sheets

(56) References Cited

U.S. PATENT DOCUMENTS

| | | | |
|---|---|---|---|
| 8,980,612 | B2 | 3/2015 | Donaldson et al. |
| 2004/0175831 | A1 | 9/2004 | Thevelein et al. |
| 2007/0031918 | A1 | 2/2007 | Dunson et al. |
| 2007/0259411 | A1 | 11/2007 | Bramucci et al. |
| 2008/0182308 | A1 | 7/2008 | Donaldson et al. |
| 2008/0261230 | A1 | 10/2008 | Liao et al. |
| 2008/0293125 | A1 | 11/2008 | Subbian et al. |
| 2009/0305370 | A1 | 12/2009 | Grady et al. |
| 2010/0081154 | A1 | 4/2010 | Flint et al. |
| 2010/0081179 | A1 | 4/2010 | Anthony et al. |
| 2010/0081182 | A1 | 4/2010 | Paul et al. |
| 2010/0093020 | A1 | 4/2010 | Bramucci et al. |
| 2010/0120105 | A1 | 5/2010 | Anthony et al. |
| 2011/0124060 | A1 | 5/2011 | Anthony et al. |
| 2011/0136192 | A1 | 6/2011 | Paul et al. |
| 2011/0195505 | A1 | 8/2011 | Euler et al. |
| 2011/0244536 | A1 | 10/2011 | Nagarajan et al. |
| 2011/0250610 | A1 | 10/2011 | Bramucci et al. |
| 2012/0058541 | A1 | 3/2012 | Alsaker et al. |
| 2012/0064561 | A1 | 3/2012 | Flint et al. |
| 2012/0149080 | A1 | 6/2012 | Bramucci et al. |
| 2012/0196341 | A1 | 8/2012 | Donaldson et al. |
| 2012/0237988 | A1 | 9/2012 | Anthony et al. |
| 2012/0258873 | A1 | 10/2012 | Gibson et al. |
| 2013/0035515 | A1 | 2/2013 | Dobson et al. |
| 2013/0071898 | A1 | 3/2013 | Anthony et al. |
| 2013/0171706 | A1 | 7/2013 | Donaldson et al. |
| 2013/0203138 | A1 | 8/2013 | McElvain |
| 2013/0252296 | A1 | 9/2013 | Maggio-Hall |
| 2013/0316414 | A1 | 11/2013 | Paul |
| 2014/0004526 | A1 | 1/2014 | Dauner et al. |
| 2014/0030782 | A1 | 1/2014 | Anthony et al. |
| 2014/0030783 | A1 | 1/2014 | Anthony et al. |
| 2014/0038263 | A1 | 2/2014 | Flint et al. |
| 2014/0038268 | A1 | 2/2014 | Flint et al. |
| 2014/0051133 | A1 | 2/2014 | Govindarajan et al. |
| 2014/0051137 | A1 | 2/2014 | Flint et al. |
| 2014/0057329 | A1 | 2/2014 | Li et al. |
| 2014/0093930 | A1 | 4/2014 | Li et al. |
| 2014/0096439 | A1 | 4/2014 | Bramucci et al. |
| 2014/0141479 | A1 | 5/2014 | Anthony et al. |
| 2014/0170732 | A1 | 6/2014 | Bramucci et al. |
| 2014/0186910 | A1 | 7/2014 | Rothman et al. |
| 2014/0186911 | A1 | 7/2014 | Anthony et al. |
| 2014/0335582 | A1 | 11/2014 | Donaldson et al. |
| 2014/0349349 | A1 | 11/2014 | Dauner et al. |

OTHER PUBLICATIONS

Sen et al., Developments in directed evolution for improving enzyme functions. Appl. Biochem. Biotechnol., 2007, vol. 143: 212-223.*

Whisstock et al., Prediction of protein function from protein sequence. Q. Rev. Biophysics., 2003, vol. 36 (3): 307-340.*

Wishart et al., A single mutation converts a novel phosphotyrosine binding domain into a dual-specificity phosphatase. J. Biol. Chem., 1995, vol. 270(45): 26782-26785.*

Witkowski et al., Conversion of b-ketoacyl synthase to a Malonyl Decarboxylase by replacement of the active cysteine with glutamine. Biochemistry, 1999, vol. 38: 11643-11650.*

Aden et al., "Lignocellulosic Biomass to Ethanol Process Design and Economics Utilizing Co-Current Dilute Acid Prehydrolysis and Enzymatic Hydrolysis for Corn Stover", Report NREL/TP-510-32438, National Renewable Energy Laboratory, Jun. 2002.

Akada et al., "PCR-mediated seamless gene deletion and marker recycling in *Saccharomyces cerevisiae*", Yeast (2006) 23, pp. 399-405.

Ausubel et al., "Current Protocols in Molecular Biology", published by Greene Publishing Assoc. and Wiley-Interscience, 1987.

Bellion et al., "Methylamine Utilization in Yeast and Bacteria: Studies Using in vivo NMR", Microbial Growth C1 Compounds [Int. Symp.], 7th ed., 415-32. Editor(s): Murrell, J. Collin; Kelly, Don P. Publisher: Intercept, Andover, UK, 1993.

Bitterman et al., "Longevity Regulation in *Saccharomyces cerevisiae*: Linking Metabolism, Genome Stability, and Heterochromatin", Microbiology and Molecular Biology Reviews (2003) vol. 67 No. 3 pp. 376-399.

Brutlag et al., "Improved sensitivity of biological sequence database searches", CABIOS, vol. 6, No. 3 (1990), pp. 237-245.

Chalker et al., "Ty3 integrates within the region of RNA polymerase III transcription initiation", Genes and Development (1992) 6:117-128.

Deshpande, "Ethanol Production from Cellulose by Coupled Saccharification/Fermentation using *Saccharomyces cerevisiae* and Cellulase Complex from Sclerotium rolfsii UV-8 Mutant", Applied Biochemistry and Biotechnology, vol. 36 (1992) pp. 227-234.

Dickinson et al., "An investigation of the metabolism of valine to isobutyl alcohol in *Saccharomyces cerevisiae*", The Journal of Biological Chemistry, vol. 273, No. 40, Oct. 2, 1998, pp. 25751-25756.

Dickinson, "Filament Formation in *Saccharomyces cerevisiae*—a Review" Folia Microbiologica (2008) 53 (1), 3-14.

Doherty and Malone, "Heterogeneous Azeotropic Distillation" Conceptual Design of Distillation Systems, Chapter 3, pp. 364-367, McGraw Hill, New York, 2001.

Durre, "New insights and novel developments in clostridial acetone/butanol/isopropanol fermentation", Appl. Microbiol. Biotechnol. (1998) vol. 49, pp. 639-648.

Frohman et al., "Rapid production of full-length cDNAs from rare transcripts:Amplification using a single gene-specific oligonucleotide primer", Proc. Natl. Acad. Sci. U.S.A. 85:8998-9002 (1988).

Garcia-Alles et al. "Phosphoenolpyruvate- and ATP-Dependent Dihydroxyacetone Kinases: Covalent Substrate-Binding and Kinetic Mechanism" Biochemistry 2004, 43:13037-13046.

Groot et al., "Technologies for butanol recovery integrated with fermentations", Process Biochemistry, vol. 27 (1992) pp. 61-75.

Guo et al., "Pervaporation study on the dehydration of aqueous butanol solutions: a comparison of flux vs. permeance, separation factor vs. selectivity", Journal of Membrane Science 245 (2004) pp. 199-210.

Heil-Chapdelaline et al.,"The Cortical Protein Num1p Is Essential for Dynein-dependent Interactions of Microtubules with the Cortex", Journal of Cell Biology (2000) 151:1337-1344.

Jones, A. et al. "Microbial Metabolism of Amino Alcohols" Biochem J. (1973) 134:167-182.

Kataoka, "DNA Sequence and Characterization of the S. cerevisiae Gene Encoding Adenylate Cyclase" Cell (1985) 43:493-505.

Kim et al, "Two Glucose-sensing Pathways Converge on Rgt1 to Regulate Expression of Glucose Transporter Genes in *Saccharomyces cerevisiae*", J. Biol. Chem. vol. 281, No. 36, pp. 26144-26149 (2006).

Kormanec, et al., "Nuclear migration in *Saccharomyces cerevisiae* is controlled by the highly repetitive 313 kDa NUM1 protein", Molecular and General Genetics (1991) 230:277-287.

Krogh et al., "Hidden Markov Models in Computational Biology—Applications to Protein Modeling", Journal Molecular Biology, 1994, vol. 235, pp. 1501-1531.

Liu, H., et al. "*Saccharomyces cerevisiae* S288C Has a Mutation in FL08, a Gene Required for Filamentous Growth" Genetics (1996) 144:967-978.

Loh et al., "Polymerase Chain Reaction with Single-Sided Specificity: Analysis of T Cell Receptor 8 Chain", Science 243:217 (1989).

Longo, V., "The Ras and Sch9 pathways regulate stress resistance and longevity", Experimental Gerontology (2003) 38:807-811.

Matsumoto, K., "Isolation and characterization of yeast mutants deficient in adenylate cyclase and cAMP-dependent protein kinase", Proc. Natl. Acad. Sci. U.S.A. (1982) 79:2355-2359.

Nakamura et al., "Codon usage tabulated from international DNA sequence databases: status for the year 2000," Nucleic Acids Research, 2000, vol. 28, No., p. 292.

Ohara et al., "One-sided polymerase chain reaction: The amplification of cDNA" Proc. Natl. Acad. Sci. USA 86:5673 (1989).

Rychlik, W., "Selection of Primers for Polymerase Chain Reaction", Methods in Molecular Biology, vol. 15, PCR Protocols: Current Methods and Applications, edited by B.A. White, 1993 Humania Press, Totowa, N.J.

(56) References Cited

OTHER PUBLICATIONS

Sambrook, J., Fritsch, E. F. and Maniatis, T. Molecular Cloning: A Laboratory Manual, 2nd ed., Cold Spring Harbor Laboratory: Cold Spring Harbor, NY (1989), particularly 9.50-9.51, 11.7-11.8 and Table 11.1.
Santangelo, "Glucose Signaling in *Saccharomyces cerevisiae*", Microbiology and Molecular Biology Reviews (2006) 70:253-282.
Shin, J. et al. "Exploring the Active Site of Amine:Pyruvate Aminotransferase on the Basis of the Substrate Structure-Reactivity Relationship: How the Enzyme Controls Substrate Specificity and Stereoselectivity", J. Org. Chem. 67:2848-2853 (2002).
Silhavy et al., "Experiments with Gene Fusions", Cold Spring Harbor Laboratory Press Cold Spring Harbor, NY, 1984.
Soares, "Flocculation in *Saccharomyces cerevisiae*: a review" Journal of Applied Microbiology (2011) 110:1-18.
Speranza et al., "Conversion of Meso-2,3-Butanediol into 2-Butanol by Lactobacilli, Stereochemical and Enzymatic Aspects", J. Agric. Food Chem. (1997) 45:3476-3480.
Sulter et al., "Proliferation and metabolic significance of peroxisomes in candida boidinii during growth on D-alanine or oleic acid as the sole carbon source", Arch. Microbiol., vol. 153, pp. 485-489 (1990).
Suzuki, et al., "Molecular machinery of autophagosome formation in yeast, *Saccharomyces cerevisiae*", FEBS Letters (2007) 581:2156-2161.
Suzuki, N. et al., "Leucine-rich repeats and carboxyl terminus are required for interaction of yeast adenylate cyclase with RAS proteins", Proc. Natl. Acad. Sci. U.S.A. (1990) 87:8711-8715.
Tabor et al., "A bacteriophage T7 RNA polymerase/promoter system for controlled exclusive expression of specific genes", Proceedings of the National Academy of Sciences USA, vol. 82 (1985) pp. 1074-1078.
Thein, S. et al, "The use of synthetic oligonucleotides as specific hybridization probes in the diagnosis of genetic disorders", in Human Genetic Diseases: A Practical Approach, K. E. Davis Ed., (1986) pp. 33-50, IRL: Herndon, Va.
Van Ness et al., "The use of oligodeoxynucleotide probes in chaotrope-based hybridization solutions", Nucl. Acids Res. 19:5143-5151 (1991).
Viswanathan et al., "Seripauperins of *Saccharomyces cerevisiae*: a new multigene family encoding serine-poor relatives of serine-rich proteins", Gene (1994) 148:149-153.
Walker et al., "Isothermal in vitro amplification of DNA by a restriction enzyme/DNA polymerase system", Proceedings of the National Academy of Sciences USA, vol. 89, Jan. 1992, pp. 392-396.
Yasuta et al. "DNA Sequence and Mutational Analysis of Rhizobitoxine Biosynthesis Genes in Bradyrhizobium elkanii", Appl. Environ. Microbial. (2001) 67:4999-5009.
Mardis, E. R., "Next-Generation DNA Sequencing Methods," Annu. Rev. Genom. Human Genet. 9:387-402 (2008).
Funakoshi et al., "Analyses of APG13 gene involved in autophagy in yeast, *Saccharomyces cerevisiae*," Gene 192:207-13 (1992).
Dickinson, "Filament formation in *Saccharomyces cerevisiae*," Folia Microbiologica 53(1):3-14 (2008).
Casperson et al., "Isolation of the gene encoding adenylate cyclase in *Saccharomyces cerevisiae*," PNAS 82:5060-3 (1985).
U.S. Appl. No. 13/227,016, filed Sep. 7, 2011.
U.S. Appl. No. 14/207,823, filed Mar. 13, 2014.
U.S. Appl. No. 14/208,474, filed Mar. 13, 2014.
U.S. Appl. No. 14/282,722, filed May 20, 2014.
U.S. Appl. No. 14/302,097, filed Jun. 11, 2014.
U.S. Appl. No. 14/368,970, filed Jun. 26, 2014.
U.S. Appl. No. 14/571,817, filed Dec. 16, 2014.
U.S. Appl. No. 14/581,898, filed Dec. 23, 2014.
U.S. Appl. No. 14/585,261, filed Dec. 30, 2014.

\* cited by examiner

BUTANOL TOLERANCE IN MICROORGANISMS

CROSS-REFERENCE TO RELATED APPLICATIONS

This application is related to and claims the benefit of priority of U.S. Provisional Application Ser. Nos. 61/709,178, filed Oct. 3, 2012, and 61/846,771, filed Jul. 16, 2013, the entirety of each of which is herein incorporated by reference.

GOVERNMENT LICENSE RIGHTS

This invention was made with Government support under Agreement DE-AR0000006 awarded by the United States Department of Energy. The Government has certain rights in this invention.

REFERENCE TO SEQUENCE LISTING SUBMITTED ELECTRONICALLY

The content of the electronically submitted sequence listing in ASCII text file (Name: 201301003_CL5586USNP_SeqListing_ST25.txt, Size: 2,395,247 bytes, and Date of Creation: Oct. 3, 2013) filed with the application is incorporated herein by reference in its entirety.

FIELD OF THE INVENTION

The invention relates to the field of microbiology and genetic engineering. More specifically, the invention relates to recombinant yeast host cells and methods for their use for production of fermentation products such as butanol.

BACKGROUND OF THE INVENTION

Butanol is an important industrial chemical, useful as a fuel additive, as a feedstock chemical in the plastics industry, and as a foodgrade extractant in the food and flavor industry. Each year 10 to 12 billion pounds of butanol are produced by petrochemical means and the need for this commodity chemical will likely increase.

Butanol may be made through chemical synthesis or by fermentation. Isobutanol is a component of "fusel oil", which can form under certain conditions as a result of incomplete metabolism of amino acids by yeast. Under some circumstances, isobutanol, may be produced from catabolism of L-valine. (See, e.g., Dickinson et al., *J. Biol. Chem.* 273 (40): 25752-25756 (1998)). Additionally, recombinant microbial production hosts, expressing an isobutanol biosynthetic pathway have been described. (Donaldson et al., commonly owned U.S. Pat. Nos. 7,851,188 and 7,993,889).

Efficient biological production of butanols may be limited by butanol toxicity to the host microorganism used in fermentation for butanol production. Accordingly, there is a need for genetic modifications which may confer tolerance to butanol.

SUMMARY OF THE INVENTION

Provided herein are recombinant yeast cells comprising an pyruvate utilizing biosynthetic pathway and further comprising 1) reduced pyruvate decarboxylase activity, 2) modified adenylate cyclase activity, or 3) both.

In some embodiments the reduced pyruvate decarboxylase activity comprises a deletion, disruption, or mutation in an endogenous pyruvate decarboxylase gene. In some embodiments the pyruvate decarboxylase gene is PDC1, PDC5, PDC6, or combinations thereof.

In some embodiments the modified adenylate cyclase activity results in altered levels of cAMP in the yeast cells as compared to a yeast cell without modified adenylate cyclase activity. In some embodiments the modified adenylate cyclase activity comprises a mutation in an adenylate cyclase gene. In some embodiments the adenylate cyclase gene encodes a polypeptide having at least 80%, at least 85%, at least 90%, at least 95%, or at least 98% sequence identity to SEQ ID NO: 1. In some embodiments the adenylate cyclase gene encodes a polypeptide having at least 90% sequence identity to SEQ ID NO: 1. In some embodiments the adenylate cyclase gene encodes a polypeptide having at least 95% sequence identity to SEQ ID NO: 1. In further embodiments the adenylate cyclase gene is CYR1. In some embodiments the adenylate cyclase gene comprises a mutation in its catalytic domain. In some embodiments the mutation is in a regulatory sequence of the adenylate cyclase gene. In some embodiments the yeast cells comprise a deletion, disruption or mutation in a gene that regulates adenylate cyclase activity. In some embodiments the yeast comprise a deletion, disruption, or mutation in GPR1, GPA2, RAS1, or RAS2, or a combination thereof.

In some embodiments the yeast comprise a substitution at a residue equivalent to A1814 of SEQ ID NO: 1. In some embodiments the yeast comprise a substitution at a residue equivalent to H1873 of SEQ ID NO: 1. In some embodiments the yeast comprise a substitution at a residue equivalent to A1814 of SEQ ID NO: 1 and further comprise a substitution at a residue equivalent to H1873 of SEQ ID NO: 1. In some embodiments the yeast comprise at least one gene encoding an adenylate cylcase having at least 80%, at least 90%, or at least 95% sequence identity to SEQ ID NO: 2. In some embodiments the yeast comprise at least one gene encoding the polypeptide of SEQ ID NO: 2. In some embodiments the yeast comprise at least one gene encoding an adenylate cylcase having at least 80%, at least 90%, or at least 95% sequence identity to SEQ ID NO: 3. In some embodiments the yeast comprise at least one gene encoding the polypeptide of SEQ ID NO: 3. In some embodiments the yeast comprise a gene encoding an adenylate cylcase having at least 80%, at least 90%, at least 95%, or at least 100% sequence identity to SEQ ID NO: 2 and further comprise an adenylate cyclase having at least 80%, at least 90%, at least 95%, or at least 100% sequence identity to SEQ ID NO: 3.

In some embodiments the yeast comprise a mutation in a gene selected from the group consisting of FLO9, NUM1, PAU10, YGR109W-B, HSP32, ATG13, and combinations thereof.

In some embodiments the pyruvate utilizing biosynthetic pathway is an engineered C3-C6 alcohol production pathway. In some embodiments the C3-C6 alcohol is selected from the group consisting of propanol, butanol, pentanol, and hexanol. In some embodiments the C3-C6 alcohol is butanol. In some embodiments the butanol is isobutanol. In some embodiments the engineered pathway comprises the following substrate to product conversions:

a. pyruvate to acetolactate;
b. acetolactate to 2,3-dihydroxyisovalerate;
c. 2,3-dihydroxyisovalerate to α-ketoisovalerate;
d. α-ketoisovalerate to isobutyraldehyde; and
e. isobutyraldehyde to isobutanol; and wherein
  i. the substrate to product conversion of step (a) is performed by a recombinantly expressed acetolactate synthase enzyme;

ii. the substrate to product conversion of step (b) is performed by a recombinantly expressed acetohydroxy acid isomeroreductase enzyme;
iii. the substrate to product conversion of step (c) is performed by a recombinantly expressed acetohydroxy acid dehydratase enzyme;
iv. the substrate to product conversion of step (d) is performed by a recombinantly expressed decarboxylase enzyme; and
v. the substrate to product conversion of step (e) is performed by an alcohol dehydrogenase enzyme;

whereby isobutanol is produced from pyruvate via the substrate to product conversions of steps (a)-(e).

In some embodiments the microorganism comprises a recombinantly expressed acetolactate synthase enzyme selected from the group consisting of:
(a) an acetolactate synthase having the EC number 2.2.1.6;
(b) a polypeptide that has at least 90% identity to any one or more of SEQ ID NO:4, SEQ ID NO:5, or SEQ ID NO:6;
(c) a polypeptide encoded by a nucleic acid sequence that has at least 90% identity to any one or more of SEQ ID NOs: 7, 8, or 9;
(d) a polypeptide encoded by a nucleic acid sequence that is complementary to any one or more of SEQ ID NOs: 7, 8 or 9;
(e) a polypeptide encoded by a nucleic acid sequence that hybridizes under stringent conditions any one or more of SEQ ID NOs: 7, 8, or 9; and
(f) any two or more of (a), (b), (c), (d) or (e).

In some embodiments the microorganism comprises a recombinantly expressed acetohydroxy acid isomeroreductase enzyme selected from the group consisting of:
(a) an acetohydroxy acid isomeroreductase having the EC number 1.1.1.86;
(b) an acetohydroxy acid isomeroreductase that matches the KARI Profile HMM with an E value of $<10^{-3}$ using hmmsearch;
(c) a polypeptide that has at least 90% identity to any one or more of SEQ ID NOs: 10; 11 or 12;
(d) a polypeptide encoded by a nucleic acid sequence that has at least 90% identity to any one or more of SEQ ID NOs: 13, 14, 15 or 16;
(e) a polypeptide encoded by a nucleic acid sequence that is complementary to any one or more of SEQ ID NOs: 13, 14, 15 or 16;
(f) is a polypeptide encoded by a nucleic acid sequence that hybridizes under stringent conditions any one or more of SEQ ID NOs: 13, 14, 15 or 16; and
(g) any two or more of (a), (b), (c), (d), (e) or (f).

In some embodiments the microorganism comprises a recombinantly expressed acetohydroxy acid dehydratase enzyme selected from the group consisting of:
(a) an acetohydroxy acid dehydratase having the EC number 4.2.1.9;
(b) a polypeptide that has at least 90% identity to any one or more of SEQ ID NO: 17; SEQ ID NO: 18, SEQ ID NO: 19 or SEQ ID NO: 20;
(c) a polypeptide encoded by a nucleic acid sequence that has at least 90% identity to any one or more of SEQ ID NOs: 21, 22, 23, or 24;
(d) a polypeptide encoded by a nucleic acid sequence that is complementary to any one or more of SEQ ID NOs: 21, 22, 23 or 24;
(e) a polypeptide encoded by a nucleic acid sequence that hybridizes under stringent conditions any one or more of SEQ ID NOs: 21, 22, 23, or 24; and
(f) any two or more of (a), (b), (c), (d) or (e).

In some embodiments the microorganism comprises a decarboxylase enzyme selected from the group consisting of:
(a) an α-keto acid decarboxylase having the EC number 4.1.1.72;
(b) a pyruvate decarboxylase having the EC number 4.1.1.1;
(c) a polypeptide that has at least 90% identity to SEQ ID NO: 25; SEQ ID NO: 26, or both;
(d) a polypeptide encoded by a nucleic acid sequence that has at least 90% identity to any one or more of SEQ ID NOs: 27, 28, or 29;
(e) is a polypeptide encoded by a nucleic acid sequence that is complementary to any one or more of SEQ ID NOs: 27, 28, or 29;
(f) is a polypeptide encoded by a nucleic acid sequence that hybridizes under stringent conditions any one or more of SEQ ID: 27, 28, or 29; and
(g) any two or more of (a), (b), (c), (d), (e) or (f).

In some embodiments the yeast is a member of the genus selected from the group consisting of *Saccharomyces, Schizosaccharomyces, Hansenula, Candida, Kluyveromyces, Yarrowia, Issatchenkia*, or *Pichia*. In some embodiments the yeast is selected from the group consisting of *Saccharomyces cerevisiae, Schizosaccharomyces pombe, Kluyveromyces lactis, Kluyveromyces thermotolerans, Kluyveromyces marxianus, Candida glabrata, Candida albicans, Pichia stipitis*, or *Yarrowia lipolytica*. In some embodiments the yeast is *Saccharomyces cerevisiae*.

In some embodiments the yeast has an increased biomass yield as compared to a corresponding microorganism that does not have modified adenylate cyclase activity. In some embodiments the increased biomass yield is from at least about a 10% to about a 50% increase, from at least about a 20% to about a 40% increase in biomass yield, or from at least about a 30% to about a 45% increase in biomass yield. In some embodiments the carbon flow through the pyruvate utilizing pathway is not reduced compared to the corresponding microorganism that does not have modified adenylate cyclase activity.

Also provided herein is a method of producing a fermentation product from a pyruvate biosynthetic pathway comprising providing the recombinant yeast described herein and growing the yeast under conditions whereby the fermentation product is produced from pyruvate. In some embodiments the fermentation product is a C3-C6 alcohol. In some embodiments the C3-C6 alcohol is selected from the group consisting of propanol, butanol, pentanol, and hexanol. In some embodiments the C3-C6 alcohol is butanol. In some embodiments the butanol is isobutanol.

In some embodiments the method comprises providing a yeast comprising an engineered isobutanol production pathway. In some embodiments the method comprises providing a yeast comprising a recombinantly expressed acetolactate synthase enzyme as described herein. In some embodiments the method comprises providing a yeast comprising a recombinantly expressed acetohydroxy acid isomeroreductase enzyme as described herein. In some embodiments the method comprises providing a yeast comprising a recombinantly expressed acetohydroxy acid dehydratase enzyme as described herein. In some embodiments the method comprises providing a yeast comprising a decarboxylase enzyme as described herein.

In some embodiments the butanol is recovered from the fermentation medium. In some embodiments the butanol is recovered by distillation, liquid-liquid extraction, extraction, adsorption, decantation, pervaporation, or combinations thereof. In some embodiments solids are removed from the fermentation medium. In some embodiments the solids are removed by centrifugation, filtration, or decantation. In some embodiments the solids are removed before recovering the butanol.

In some embodiments the fermentation product is produced by batch, fed-batch, or continuous fermentation.

Also provided herein is a method of using a C3-C6 alcohol, produced by the methods provided herein, as a component of a bio-based fuel. In some embodiments the C3-C6 alcohol is selected from the group consisting of propanol, butanol, pentanol, and hexanol. In some embodiments the C3-C6 alcohol is butanol. In some embodiments the butanol is isobutanol.

Also provided herein is a bio-based fuel comprising a C3-C6 alcohol produced by the methods provided herein. In some embodiments the C3-C6 alcohol is selected from the group consisting of propanol, butanol, pentanol, and hexanol. In some embodiments the C3-C6 alcohol is butanol. In some embodiments the butanol is isobutanol.

BRIEF DESCRIPTION OF THE DRAWINGS

The various embodiments of the invention can be more fully understood from the following detailed description and the accompanying sequence descriptions, which form a part of this application.

DETAILED DESCRIPTION

Figure 1:
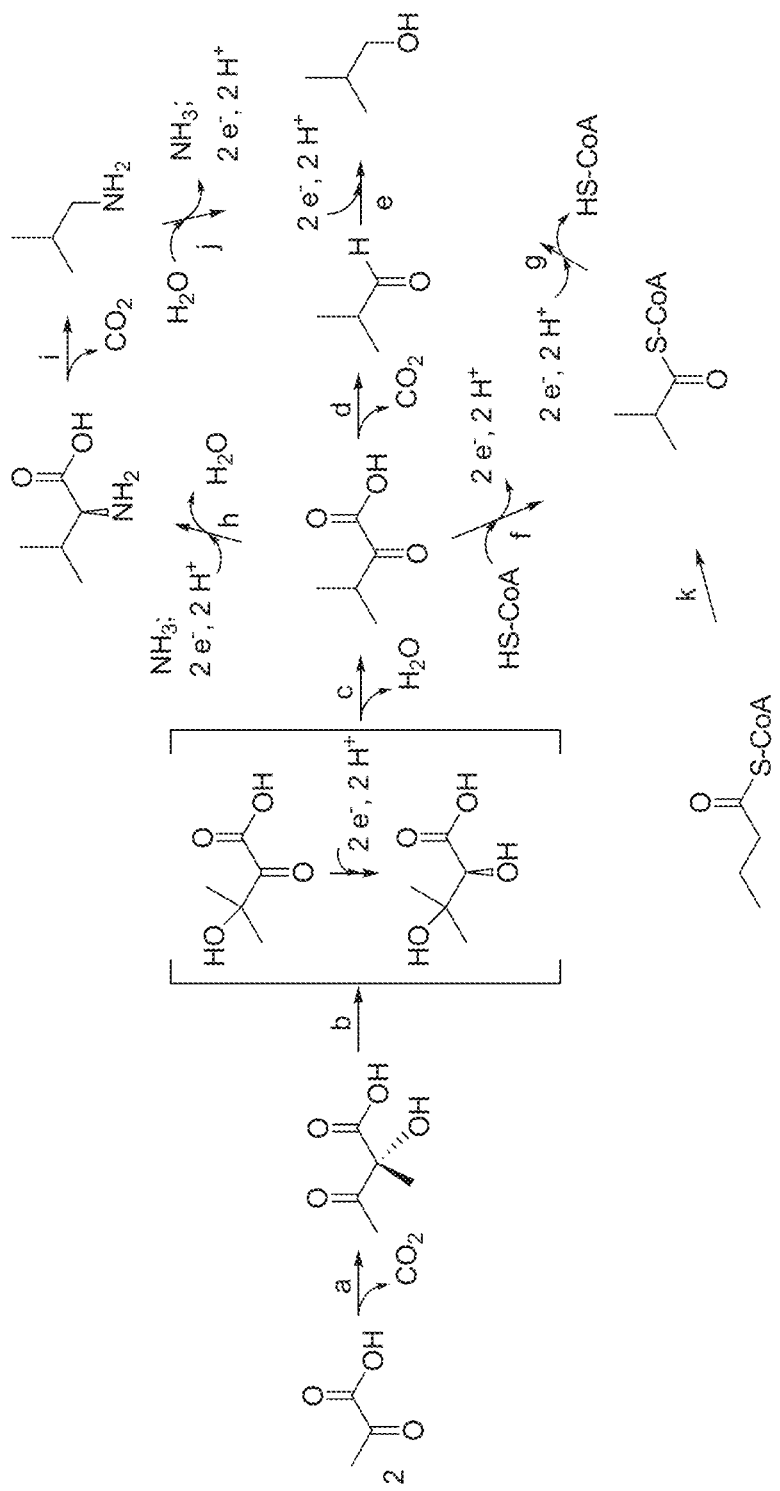
FIG. 1 depicts different isobutanol biosynthetic pathways. The steps labeled "a", "b", "c", "d", "e", "f", "g", "h", "i", "j", and "k" represent substrate to product conversions described below. "a" may be catalyzed, for example, by acetolactate synthase. "b" may be catalyzed, for example, by acetohydroxyacid reductoisomerase. "c" may be catalyzed, for example, by acetohydroxy acid dehydratase. "d" may be catalyzed, for example, by branched-chain keto acid decarboxylase. "e" may be catalyzed, for example, by branched chain alcohol dehydrogenase. "f" may be catalyzed, for example, by branched chain keto acid dehydrogenase. "g" may be catalyzed, for example, by acetylating aldehyde dehydrogenase. "h" may be catalyzed, for example, by transaminase or valine dehydrogenase. "i" may be catalyzed, for example, by valine decarboxylase. "j" may be catalyzed, for example, by omega transaminase. "k" may be catalyzed, for example by isobutyryl-CoA mutase.

As described herein, Applicants employed environmental evolution to isolate strains of yeast tolerant to higher levels of butanol. From this environmental evolution, strains were isolated that were tolerant to butanol in the fermentation medium. Furthermore, the isolated strains had an increased ability to utilize glucose and produce a fermentation product from a pyruvate utilizing pathway in the presence of butanol in the fermentation medium. Analysis of the isolated butanol tolerant strains revealed that the evolved strains had acquired mutations in seven genes (FLO9, NUM1, PAU10, YGR109W-B, HSP32, ATG13, and CYR1). In another embodiment, yeast cells comprising a variant CYR1 and further comprising reduced pyruvate decarboxylase activity had increased glucose utilization and biomass production, while maintaining carbon flow through an engineered isobutanol biosynthetic pathway, as compared to yeast cells not expressing a variant CYR1 gene, suggesting that the environmental evolution methods disclosed herein provide the ability to identify genes that have a role in conferring tolerance to alcohols and increasing production of fermentation products.

The present invention relates to recombinant yeast cells that are engineered for the production of a fermentation product that is synthesized from pyruvate and that additionally comprise modified adenylate cyclase activity and, in some embodiments, reduced pyruvate decarboxylase activity. The present yeast cells may have altered cAMP levels through a deletion, disruption, or mutation in a gene that regulates adenylate cyclase activity or a mutation in an adenylate cyclase gene. These yeast cells have increased tolerance to butanol and increased biomass yield, and they can be used for the production of C3-C6 alcohols, such as butanol, which are valuable as fuel additives to reduce demand for fossil fuels.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers may be added to the specified method, composition, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

In some instances, "biomass" as used herein refers to the cell biomass of the fermentation product-producing microorganism.

The term "bio-based fuel" as used herein refers to a fuel in which the carbon contained within the fuel is derived from recently living biomass. "Recently living biomass" are defined as organic materials having a $^{14}C/^{12}C$ isotope ratio in the range of from 1:0 to greater than 0:1 in contrast to a fossil-based material which has a $^{14}C/^{12}C$ isotope ratio of 0.1. The $^{14}C/^{12}C$ isotope ratio can be measured using methods known in the art such as the ASTM test method D 6866-05 (Determining the Biobased Content of Natural Range Materials Using Radiocarbon and Isotope Ratio Mass Spectrometry Analysis). A bio-based fuel is a fuel in its own right, but may be blended with petroleum-derived fuels to generate a fuel. A bio-based fuel may be used as a replacement for petrochemically-derived gasoline, diesel fuel, or jet fuel.

The term "fermentation product" includes any desired product of interest, including, but not limited to lactic acid, 3-hydroxy-propionic acid, acrylic acid, acetic acid, succinic acid, citric acid, fumaric acid, malic acid, itaconic acid, 1,3-propane-diol, ethylene, glycerol, isobutyrate, butanol and other lower alkyl alcohols, etc.

The term "lower alkyl alcohol" refers to any straight-chain or branched, saturated or unsaturated, alcohol molecule with 1-10 carbon atoms.

The term "C3-C6 alcohol" refers to any alcohol with 3-6 carbon atoms.

The term "pyruvate utilizing biosynthetic pathway" refers to any enzyme pathway that utilizes pyruvate as its starting substrate.

The term "butanol" refers to 1-butanol, 2-butanol, 2-butanone, isobutanol, or mixtures thereof. Isobutanol is also known as 2-methyl-1-propanol.

The term "engineered" as used herein refers to an enzyme pathway that is not present endogenously in a microorganism and is deliberately constructed to produce a fermentation product from a starting substrate through a series of specific substrate to product conversions.

The term "C3-C6 alcohol pathway" as used herein refers to an enzyme pathway to produce C3-C6 alcohols. For example, engineered isopropanol biosynthetic pathways are disclosed in U.S. Patent Appl. Pub. No. 2008/0293125, which is incorporated herein by reference. From time to time "C3-C6 alcohol pathway" is used synonymously with "C3-C6 alcohol production pathway".

The term "butanol biosynthetic pathway" as used herein refers to an enzyme pathway to produce 1-butanol, 2-butanol, 2-butanone or isobutanol. For example, engineered isobutanol biosynthetic pathways are disclosed in U.S. Pat. Nos. 7,851,188 and 7,993,889, which are incorporated by reference herein. Additionally, an example of an engineered 1-butanol pathway is disclosed in U.S. Patent Appl. Pub. No. 2008/0182308, which is incorporated by reference herein. Examples of engineered 2-butanol and 2-butanone biosynthetic pathways are disclosed in U.S. Pat. No. 8,206,970 and U.S. Patent Pub. No. 2009/0155870, which are incorporated by reference herein. From time to time "butanol biosynthetic pathway" is used synonymously with "butanol production pathway".

The term "isobutanol biosynthetic pathway" refers to the enzymatic pathway to produce isobutanol. From time to time "isobutanol biosynthetic pathway" is used synonymously with "isobutanol production pathway".

The term "2-butanone biosynthetic pathway" as used herein refers to an enzyme pathway to produce 2-butanone.

A "recombinant microbial host cell" is defined as a host cell that has been genetically manipulated to express a biosynthetic production pathway, wherein the host cell either produces a biosynthetic product in greater quantities relative to an unmodified host cell or produces a biosynthetic product that is not ordinarily produced by an unmodified host cell.

The term "fermentable carbon substrate" refers to a carbon source capable of being metabolized by the microorganisms such as those disclosed herein. Suitable fermentable carbon substrates include, but are not limited to, monosaccharides, such as glucose or fructose; disaccharides, such as lactose or sucrose; oligosaccharides; polysaccharides, such as starch, cellulose, or lignocellulose, hemicellulose; one-carbon substrates, fatty acids; and a combination of these.

"Fermentation medium" as used herein means the mixture of water, sugars (fermentable carbon substrates), dissolved solids, microorganisms producing fermentation products, fermentation product and all other constituents of the material held in the fermentation vessel in which the fermentation product is being made by the reaction of fermentable carbon substrates to fermentation products, water and carbon dioxide ($CO_2$) by the microorganisms present. From time to time, as used herein the term "fermentation broth" and "fermentation mixture" can be used synonymously with "fermentation medium."

The term "aerobic conditions" as used herein means growth conditions in the presence of oxygen.

The term "microaerobic conditions" as used herein means growth conditions with low levels of dissolved oxygen. For example, the oxygen level may be less than about 1% of air-saturation.

The term "anaerobic conditions" as used herein means growth conditions in the absence of oxygen.

"Butanol tolerance" or "tolerance to butanol" as used herein refers to the degree of effect butanol has on one or more of the following characteristics of a host cell in the presence of fermentation medium containing aqueous butanol: aerobic growth rate or anaerobic growth rate (typically a change in grams dry cell weight per liter fermentation medium per unit time, which may be expressed as "mu"), change in biomass (which may be expressed, for example, as a change in grams dry cell weight per liter fermentation medium, or as a change in optical density (O.D.)) over the course of a fermentation, volumetric productivity (which may be expressed in grams butanol produced per liter of fermentation medium per unit time), specific sugar consumption rate ("qS" typically expressed in grams sugar consumed per gram of dry cell weight of cells per hour), specific isobutanol production rate ("qP" typically expressed in grams butanol produced per gram of dry cell weight of cells per hour), or yield of butanol (grams of butanol produced per grams sugar consumed). It will be appreciated that increased butanol concentrations may impact one or more of the listed characteristics. Accordingly, an improvement in butanol tolerance can be demonstrated by a reduction or elimination of such impact on one or more of the listed characteristics.

"Butanol tolerance" or "tolerance to butanol" as used herein refers to the degree of effect butanol has on one or more of the following characteristics of a host cell in the presence of fermentation medium containing aqueous butanol: aerobic growth rate or anaerobic growth rate (typically a change in grams dry cell weight per liter fermentation medium per unit time, which may be expressed as "mu"), change in biomass (which may be expressed, for example, as a change in grams dry cell weight per liter fermentation medium, or as a change in optical density (O.D.)) over the course of a fermentation, volumetric productivity (which may be expressed in grams butanol produced per liter of fermentation medium per unit time), specific sugar consumption rate ("qS" typically expressed in grams sugar consumed per gram of dry cell weight of cells per hour), specific isobutanol production rate ("qP" typically expressed in grams butanol produced per gram of dry cell weight of cells per hour), or yield of butanol (grams of butanol produced per grams sugar consumed). It will be appreciated that increased butanol concentrations may impact one or more of the listed characteristics. Accordingly, an improvement in butanol tolerance can be demonstrated by a reduction or elimination of such impact on one or more of the listed characteristics.

The term "carbon substrate" refers to a carbon source capable of being metabolized by the recombinant host cells disclosed herein. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, and mixtures thereof.

As used herein, the term "yield" refers to the amount of product per amount of carbon source in g/g. The yield may be exemplified for glucose as the carbon source. It is understood unless otherwise noted that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. For example, the theoretical yield for one typical conversion of glucose to isopropanol is 0.33 g/g. As such, a yield of isopropanol from glucose of 29.7 g/g would be expressed as 90% of theoretical or 90% theoretical yield. It is understood that while in the present disclosure the yield is exemplified for glucose as a carbon source, the invention can be applied to other carbon sources and the yield may vary depending on the carbon source used. One skilled in the art can calculate yields on various carbon sources.

The term "effective titer" as used herein, refers to the total amount of C3-C6 alcohol produced by fermentation per liter of fermentation medium. The total amount of C3-C6 alcohol includes: (i) the amount of C3-C6 alcohol in the fermentation medium; (ii) the amount of C3-C6 alcohol recovered from the organic extractant; and (iii) the amount of C3-C6 alcohol recovered from the gas phase, if gas stripping is used.

The term "effective rate" as used herein, refers to the total amount of C3-C6 alcohol produced by fermentation per liter of fermentation medium per hour of fermentation.

The term "effective yield" as used herein, refers to the amount of C3-C6 alcohol produced per unit of fermentable carbon substrate consumed by the biocatalyst.

The term "specific productivity" as used herein, refers to the g of C3-C6 alcohol produced per g of dry cell weight of cells per unit time.

As used herein the term "coding sequence" refers to a DNA sequence that encodes for a specific amino acid sequence. "regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The terms "derivative" and "analog" refer to a polypeptide differing from the enzymes of the invention, but retaining essential properties thereof. The term "derivative" may also refer to a host cells differing from the host cells of the invention, but retaining essential properties thereof. Generally, derivatives and analogs are overall closely similar, and, in many regions, identical to the enzymes of the invention. The terms "derived-from", "derivative" and "analog" when referring to enzymes of the invention include any polypeptides which retain at least some of the activity of the corresponding native polypeptide or the activity of its catalytic domain.

Derivatives of enzymes disclosed herein are polypeptides which may have been altered so as to exhibit features not found on the native polypeptide. Derivatives can be covalently modified by substitution (e.g. amino acid substitution), chemical, enzymatic, or other appropriate means with a moiety other than a naturally occurring amino acid (e.g., a detectable moiety such as an enzyme or radioisotope). Examples of derivatives include fusion proteins, or proteins which are based on a naturally occurring protein sequence, but which have been altered. For example, proteins can be designed by knowledge of a particular amino acid sequence, and/or a particular secondary, tertiary, and/or quaternary structure. Derivatives include proteins that are modified based on the knowledge of a previous sequence, natural or synthetic, which is then optionally modified, often, but not necessarily to confer some improved function. These sequences, or proteins, are then said to be derived from a particular protein or amino acid sequence. In some embodiments of the invention, a derivative must retain at least 50% identity, at least 60% identity, at least 70% identity, at least 80% identity, at least 85% identity, at least 87% identity, at least 90% identity, at least 91% identity, at least 92% identity, at least 93% identity, at least 94% identity, at least 95% identity, at least 96% identity, at least 97% identity, at least 98% identity, or at least 99% identity to the sequence the derivative is "derived-from." In some embodiments of the invention, an enzyme is said to be derived-from an enzyme naturally found in a particular species if, using molecular genetic techniques, the DNA sequence for part or all of the enzyme is amplified and placed into a new host cell.

Screening for C3-C6 Alcohol Tolerance

The invention relates to the discovery that modifying the activity of adenylate cyclase while reducing pyruvate decarboxylase activity has the effect of increasing tolerance of yeast cells to isobutanol. Furthermore, the invention relates to the discovery that yeast comprising modified adenylate cyclase activity and reduced pyruvate decarboxylase activity have increased glucose utilization and increased biomass production without decreased carbon flow through an engineered isobutanol production pathway. These discoveries came from the selection for isobutanol tolerance in high density yeast cultures.

Tolerance to C3-C6 alcohols can be selected for by growing high density cultures of yeast comprising an engineered C3-C6 alcohol production pathway and further comprising reduced pyruvate decarboxylase activity in media comprising a C3-C6 alcohol present at initially at low percentage. Because yeast comprising reduced pyruvate decarboxylase activity have a low tolerance to glucose, media comprising ethanol as the carbon source is utilized. After each round of growth, the surviving cells can be inoculated into fresh media comprising a higher percentage of C3-C6 than the previous culture and grown again to select for cells that can tolerate the higher percentage of C3-C6 alcohol in the media. Following several rounds of selection, involving increasing amounts of C3-C6 alcohol being present in the media, cultures of yeast are obtained that have evolved to survive in higher concentrations of C3-C6 alcohol.

Because the goal of evolving yeast to tolerate higher levels of C3-C6 alcohol is the ability to use them in the fermentative production of alcohol, it is important to select for strains that can ultimately utilize glucose to produce C3-C6 alcohol through an engineered C3-C6 alcohol production pathway. To accomplish this, the evolved cultures obtained by the method described above can then be sub-cultured to obtain isolated colonies of yeast. The isolated colonies can then be cultured in media comprising glucose and a C3-C6 alcohol. Monitoring of the growth rates of the cultures then allows for the identification of glucose utilizing strains that are also tolerant to C3-C6 alcohol.

From the methods described above, evolved isolates can then be tested for glucose utilization in the presence of C3-C6 alcohol by monitoring glucose consumption of the identified strains. Evolved strains can be grown in the presence of a set amount of glucose in medium which further comprises a C3-C6 alcohol. Samples can be removed at different time points and the amount of glucose remaining in the medium can be measured. Strains with increased rates of glucose consumption compared to their non-evolved parental strain can then be selected for further analysis by the methods describe herein.

The evolved strains selected for further analysis can then be subjected to whole genome sequencing using methods that are well known in the art. For example, one such method involves sequencing-by-synthesis (E. R. Mardis. 2008. Next-Generation DNA Sequencing Methods. *Annu. Rev. Genom. Human Genet.* 9:387-402). Genomic DNA is randomly sheared and specific adapters are ligated to both ends of the fragments which are then denatured. The ligated fragments are arrayed in a flow cell. Primers, fluorescently labeled, 3'-OH blocked nucleotides and DNA polymerase are added to the flow cell. The primed DNA fragments are extended by one nucleotide during the incorporation step. The unused nucleotides and DNA polymerase molecules are then washed away and the optics system scans the flow cell to image the arrayed fragments. After imaging, the fluorescent labels and the 3'-OH blocking groups are cleaved and washed away, preparing the fragments for another round of fluorescent nucleotide incorporation. Assembled genomic sequences of the evolved strains can be compared to the non-evolved parental strain to identify mutations that are present in the evolved strains but not in the non-evolved parental strain.

Identification of Mutations in Isobutanol Tolerant Strains

Employing the method described above, mutations in seven genes were identified in two separate strains that were evolved to have increased tolerance to isobutanol. Genomic sequencing of the evolved strains identified mutations in FLO9 (SEQ ID NO: 30), NUM1 (SEQ ID NO: 31), PAU10 (SEQ ID NO: 32), YGR109W-B (SEQ ID NO: 33), CYR1 (SEQ ID NO: 242), HSP32 (SEQ ID NO: 34), and ATG13 (SEQ ID NO: 35).

FLO9 encodes a lectin-like protein that is involved in flocculation (*Journal of Applied Microbiology* (2011) 110:1-18). Null mutations in FLO9 result in reduced filamentous and invasive growth (*Genetics* (1996) 144:967-978). Exposure to fusel alcohols such as isobutanol results in invasive and filamentous growth (*Folia Microbiologica* (2008) 53:3-14). Since invasive/filamentous growth may be an adaptation to solid media, mutations in FLO9 may enable cells to grow better in suspension in liquid media.

NUM1 encodes a protein required for nuclear migration during cell division. (*Molecular and General Genetics* (1991) 230:277-287). Mutations in NUM1 result defective mitotic spindle movement and nuclear segregation due to defects in dynein-dependent microtubule sliding in the yeast bud during cell division. (*Journal of Cell Biology* (2000) 151:1337-1344).

PAU10 encodes a protein of unknown function and is a member of the seripauperin multigene family. Seripauperins are serine-poor proteins that are homologous to a serine-rich protein, Srp1p. (*Gene* (1994) 148:149-153).

YGR109W-B is a Ty3 transposable element located on chromosome VII. Ty3 transposable elements prefer to integrate within the region of RNA polymerase III transcription initiation. (*Genes and Development* (1992) 6:117-128).

HSP32 encodes a possible chaperone and cysteine protease that is similar to yeast Hsp31p and *Escherichia coli* Hsp31. The function of Hsp31 like proteins is unknown.

ATG13 encodes a protein involved in autophagy. (*Gene* (1997) 192:207-213). Atg13p is important for cell viability during starvation conditions, and it is part of a protein kinase complex that is required for vesicle expansion during autophagy. (*FEBS Letters* (2007) 581:2156-2161).

CYR1 (also known as YJLOO5W in *Saccharomyces cerevisiae*) encodes an adenylate cyclase. Adenylate cyclase synthesizes cyclic-AMP ("cAMP") from ATP. (*Cell* (1985) 43:493-505). In yeast, CYR1 is an essential gene and has roles in nutrient signaling, cell cycle progression, sporulation, cell growth, response to stress, and longevity. (*Microbiology and Molecular Biology Reviews* (2003) 67:376-399; *Microbiology and Molecular Biology Reviews* (2006) 70:253-282). Null mutations in CYR1 block cell division. (*Proc. Natl. Acad. Sci. USA* (1982) 79:2355-2359). However, viable mutations of CYR1 have been isolated. For example, an E1682K mutation located in the catalytic domain of CYR1 was identified in a screen for genes that confer increased stress resistance during fermentation. (U.S. Patent Appl. Pub. No. 2004/0175831).

Adenylate Cyclase

Mutations identified in CYR1 (A1814V (SEQ ID NO: 2) and H1873N (SEQ ID NO: 3)), using the methods described herein, are located in the catalytic domain and are believed to be change of function mutations because CYR1 is an essential gene. While not wishing to be bound by theory, these mutations may alter the levels of cAMP in the host cell.

The term "adenylate cyclase" refers to an enzyme that catalyzes the synthesis of cAMP from ATP. Adenylate cyclases are known by the EC number 4.6.1.1. These enzymes are found in a number of microorganisms, and exemplary adenylate cyclases are listed in Table 1.

TABLE 1

Exemplary adenylate cyclases

| GI Number | Source Organism | SEQ ID NO |
|---|---|---|
| 1006714 | Saccharomyces cerevisiae | 1 |
| 854568 | Saccharomyces cerevisiae | 36 |
| 50311523 | Kluyveromyces lactis NRRL Y-1140 | 37 |
| 19112951 | Schizosaccharomyces pombe 972h- | 38 |
| 50547205 | Yarrowia lipolytica | 39 |
| 103488936 | Sclerotinia sclerotiorum | 40 |
| 10505261 | Candida albicans | 41 |
| 115398776 | Aspergillus terreus NIH2624 | 42 |
| 116182400 | Chaetomium globosum CBS 148.51 | 131 |
| 117793 | Lachancea kluyveri | 132 |
| 119469751 | Neosartorya fischeri NRRL 181 | 133 |
| 11991504 | Blumeria graminis | 134 |
| 121699711 | Aspergillus clavatus NRRL 1 | 135 |
| 134113755 | Cryptococcus neoformans var. neoformans B-3501A | 136 |
| 145666444 | Hypocrea virens | 137 |
| 146417121 | Meyerozyma guilliermondii ATCC 6260 | 138 |
| 149235856 | Lodderomyces elongisporus NRRL YB-4239 | 139 |
| 150864940 | Scheffersomyces stipitis CBS 6054 | 140 |
| 151945071 | Saccharomyces cerevisiae YJM789 | 141 |
| 156050257 | Sclerotinia sclerotiorum 1980 | 142 |
| 156844733 | Vanderwaltozyma polyspora DSM 70294 | 143 |
| 164660622 | Malassezia globosa CBS 7966 | 144 |
| 170092737 | Laccaria bicolor S238N-H82 | 145 |
| 193227757 | Sordaria macrospora | 146 |
| 212532995 | Penicillium marneffei ATCC 18224 | 147 |
| 213403472 | Schizosaccharomyces japonicus yFS275 | 148 |
| 225563215 | Ajellomyces capsulatus G186AR | 149 |
| 226292184 | Paracoccidioides brasiliensis Pb18 | 150 |
| 2267008 | Magnaporthe grisea | 151 |
| 238501544 | Aspergillus flavus NRRL3357 | 152 |
| 239610619 | Ajellomyces dermatitidis ER-3 | 153 |
| 242220257 | Postia placenta Mad-698-R | 154 |
| 242777086 | Talaromyces stipitatus ATCC 10500 | 155 |
| 2492894 | Podospora anserina | 156 |
| 254573340 | Komagataella pastoris GS115 | 157 |
| 254578826 | Zygosaccharomyces rouxii | 158 |
| 255711300 | Lachancea thermotolerans | 159 |
| 255732008 | Candida tropicalis MYA-3404 | 160 |
| 255932991 | Penicillium chrysogenum Wisconsin 54-1255 | 161 |
| 258574671 | Uncinocarpus reesii 1704 | 162 |
| 260949995 | Clavispora lusitaniae ATCC 42720 | 163 |
| 290972672 | Naegleria gruberi | 164 |
| 290974896 | Naegleria gruberi | 165 |
| 290982761 | Naegleria gruberi | 166 |
| 294656201 | Debaryomyces hansenii CBS767 | 167 |
| 295673474 | Paracoccidioides brasiliensis Pb01 | 168 |
| 296418802 | Tuber melanosporum Mel28 | 169 |
| 296813607 | Arthroderma otae CBS 113480 | 170 |
| 299752379 | Coprinopsis cinerea okayama7#130 | 171 |
| 302679826 | Schizophyllum commune H4-8 | 172 |
| 302922198 | Nectria haematococca mpVI 77-13-4 | 173 |
| 310791025 | Glomerella graminicola M1.001 | 174 |
| 312214245 | Leptosphaeria maculans JN3 | 175 |
| 315040884 | Arthroderma gypseum CBS 118893 | 176 |
| 317032152 | Aspergillus niger CBS 513.88 | 177 |
| 320040024 | Coccidioides posadasii str. Silveira | 178 |
| 320162830 | Capsaspora owczarzaki ATCC 30864 | 179 |
| 320167315 | Capsaspora owczarzaki ATCC 30864 | 180 |
| 320168943 | Capsaspora owczarzaki ATCC 30864 | 181 |
| 320169891 | Capsaspora owczarzaki ATCC 30864 | 182 |
| 320583708 | Ogataea parapolymorpha DL-1 | 183 |
| 320586868 | Grosmannia clavigera kw1407 | 184 |
| 321260829 | Cryptococcus gattii WM276 | 185 |

TABLE 1-continued

Exemplary adenylate cyclases

| GI Number | Source Organism | SEQ ID NO |
|---|---|---|
| 322701581 | Metarhizium acridum CQMa 102 | 186 |
| 326479788 | Trichophyton equinum CBS 127.97 | 187 |
| 327348946 | Ajellomyces dermatitidis ATCC 18188 | 188 |
| 328858251 | Melampsora larici-populina 98AG31 | 189 |
| 330930940 | Pyrenophora teres f. teres 0-1 | 190 |
| 331244965 | Puccinia graminis f. sp. tritici CRL 75-36-700-3 | 191 |
| 336372095 | Serpula lacrymans var. lacrymans S7.3 | 192 |
| 336384844 | Serpula lacrymans var. lacrymans S7.9 | 193 |
| 339471525 | Mycosphaerella graminicola IPO323 | 194 |
| 340517528 | Trichoderma reesei QM6a | 195 |
| 340924160 | Chaetomium thermophilum var. thermophilum DSM 1495 | 196 |
| 342320145 | Rhodotorula glutinis ATCC 204091 | 197 |
| 342890394 | Fusarium oxysporum Fo5176 | 198 |
| 343428888 | Sporisorium reilianum SRZ2 | 199 |
| 344229656 | Candida tenuis ATCC 10573 | 200 |
| 344299494 | Spathaspora passalidarum NRRL Y-27907 | 201 |
| 345565706 | Arthrobotrys oligospora ATCC 24927 | 202 |
| 346320908 | Cordyceps militaris CM01 | 203 |
| 347831606 | Botryotinia fuckeliana | 204 |
| 350296271 | Neurospora tetrasperma FGSC 2509 | 205 |
| 353234376 | Piriformospora indica DSM 11827 | 206 |
| 354548679 | Candida parapsilosis | 207 |
| 358059928 | Mixia osmundae IAM 14324 | 208 |
| 358395837 | Trichoderma atroviride IMI 206040 | 209 |
| 359378877 | Millerozyma farinosa CBS 7064 | 210 |
| 363756334 | Eremothecium cymbalariae DBVPG#7215 | 211 |
| 365989834 | Naumovozyma dairenensis CBS 421 | 212 |
| 366992528 | Naumovozyma castellii CBS 4309 | 213 |
| 367007106 | Tetrapisispora phaffii CBS 4417 | 214 |
| 367014755 | Torulaspora delbrueckii | 215 |
| 367018364 | Myceliophthora thermophila ATCC 42464 | 216 |
| 367052111 | Thielavia terrestris NRRL 8126 | 217 |
| 372465896 | Kazachstania africana CBS 2517 | 218 |
| 378731756 | Exophiala dermatitidis NIH/UT8656 | 219 |
| 380493389 | Colletotrichum higginsianum | 220 |
| 384490522 | Rhizopus oryzae RA 99-880 | 221 |
| 384491562 | Rhizopus oryzae RA 99-880 | 222 |
| 385303810 | Dekkera bruxellensis AWRI1499 | 223 |
| 38707444 | Colletotrichum lagenarium | 224 |
| 387512726 | Tetrapisispora blattae CBS 6284 | 225 |
| 387512970 | Tetrapisispora blattae CBS 6284 | 226 |
| 388583057 | Wallemia sebi CBS 633.66 | 227 |
| 388856735 | Ustilago hordei | 228 |
| 389624677 | Magnaporthe oryzae 70-15 | 229 |
| 389740130 | Stereum hirsutum FP-91666 SS1 | 230 |
| 389745860 | Stereum hirsutum FP-91666 SS1 | 231 |
| 390603146 | Punctularia strigosozonata HHB-11173 SS5 | 232 |
| 392570406 | Trametes versicolor FP-101664 SSI | 233 |
| 392579027 | Tremella mesenterica DSM 1558 | 234 |
| 45184662 | Ashbya gossypii ATCC 10895 | 235 |
| 46108704 | Gibberella zeae PH-1 | 236 |
| 50286251 | Candida glabrata CBS 138 | 237 |
| 58269836 | Cryptococcus neoformans var. neoformans JEC21 | 238 |
| 6634473 | Metarhizium anisopliae | 239 |
| 67526911 | Aspergillus nidulans FGSC A4 | 240 |
| 71022299 | Ustilago maydis 521 | 241 |

Additionally, the sequences of adenylate cyclase coding regions provided herein may be used to identify other homologs in nature. For example each of the adenylate cyclase encoding nucleic acid fragments described herein may be used to isolate genes encoding homologous proteins. Isolation of homologous genes using sequence-dependent protocols is well known in the art. Examples of sequence-dependent protocols include, but are not limited to: 1) methods of nucleic acid hybridization; 2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., Proc. Natl. Acad. Sci. U.S.A.

82:1074 (1985); or strand displacement amplification (SDA), Walker, et al., *Proc. Natl. Acad. Sci. U.S.A.,* 89:392 (1992)]; and 3) methods of library construction and screening by complementation.

For example, genes encoding similar proteins or polypeptides to the adenylate cyclase encoding genes provided herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency. Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in Human Genetic Diseases: A Practical Approach, K. E. Davis Ed., (1986) pp 33-50, IRL: Herndon, Va.; and Rychlik, W. In Methods in Molecular Biology, White, B. A. Ed., (1993) Vol. 15, pp 31-39, PCR Protocols: Current Methods and Applications. Humania: Totowa, N.J.).

Generally two short segments of the described sequences may be used in polymerase chain reaction protocols to amplify longer nucleic acid fragments encoding homologous genes from DNA or RNA. The polymerase chain reaction may also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence may be based upon sequences derived from the cloning vector. For example, the skilled artisan can follow the RACE protocol (Frohman et al., *Proc. Natl. Acad. Sci. U.S.A.* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *Proc. Natl. Acad. Sci. USA* 86:5673 (1989); Loh et al., *Science* 243:217 (1989)).

Alternatively, the provided adenylate cyclase encoding sequences may be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and will depend upon the specific test to be done. Typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness and Chen, *Nucl. Acids Res.* 19:5143-5151 (1991)). Suitable chaotropic agents include guanidinium chloride, guanidinium thiocyanate, sodium thiocyanate, lithium tetrachloroacetate, sodium perchlorate, rubidium tetrachloroacetate, potassium iodide and cesium trifluoroacetate, among others. Typically, the chaotropic agent will be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

Host cells provided herein may comprise a mutation in an endogenous gene which encodes an adenylate cyclase polypeptides. In embodiments, host cells provided herein may comprise a polypeptide having at least about 80%, at least about 85%, at least about 90%, at least about 95%, or at least about 98% identity to adenylate cyclase sequences provided in Table 1. In embodiments, host cells comprise polypeptides comprising mutations at positions corresponding to A1814, H1873, or both, of SEQ ID NO: 1. In embodiments, the mutation at the position corresponding to A1814 of SEQ ID NO: 1 is V. In embodiments, the mutations at the position corresponding to H1873 is N. In embodiments, the polypeptide has at least about 80%, at least about 85%, at least about 90%, at least about 95%, or at least about 98% identity to SEQ ID NOs: 2 or 3 or an active fragment thereof. In embodiments, host cells provided herein comprise polynucleotides encoding such polypeptides.

Pyruvate Decarboxylase

The term "pyruvate decarboxylase" refers to an enzyme that catalyzes the decarboxylation of pyruvic acid to acetaldehyde and carbon dioxide. Pyruvate decarboxylases are known by the EC number 4.1.1.1. These enzymes are found in a number of yeast, including *Saccharomyces cerevisiae* (GenBank No: NP_013145 (SEQ ID NO: 43), CAA97705 (SEQ ID NO: 44), CAA97091 (SEQ ID NO: 45)).

U.S. Appl. Pub. No. 2009/0305363 (incorporated by reference) discloses increased conversion of pyruvate to acetolactate by engineering yeast for expression of a cytosol-localized acetolactate synthase and substantial elimination of pyruvate decarboxylase activity. A genetic modification which has the effect of reducing glucose repression wherein the yeast production host cell is pdc- is described in U.S. Appl. Publication No. 2011/0124060, incorporated herein by reference. In some embodiments, the pyruvate decarboxylase that is deleted or downregulated is selected from the group consisting of: PDC1, PDC5, PDC6, and combinations thereof. In some embodiments, the pyruvate decarboxylase is selected from those enzymes in Table 2.

TABLE 2

SEQ ID Numbers of PDC Target Gene Coding Regions and Proteins.

| Description | SEQ ID NO: Nucleic Acid | SEQ ID NO: Amino Acid |
| --- | --- | --- |
| PDC1 pyruvate decarboxylase from *Saccharomyces cerevisiae* | 46 | 43 |
| PDC5 pyruvate decarboxylase from *Saccharomyces cerevisiae* | 47 | 44 |
| PDC6 pyruvate decarboxylase *Saccharomyces cerevisiae* | 48 | 45 |
| pyruvate decarboxylase from *Candida glabrata* | 49 | 50 |
| PDC1 pyruvate decarboxylase from *Pichia stipites* | 51 | 52 |
| PDC2 pyruvate decarboxylase from *Pichia stipites* | 53 | 54 |
| pyruvate decarboxylase from *Kluyveromyces lactis* | 55 | 56 |
| pyruvate decarboxylase from *Yarrowia lipolytica* | 57 | 58 |
| pyruvate decarboxylase from *Schizosaccharomyces pombe* | 59 | 60 |
| pyruvate decarboxylase from *Zygosaccharomyces rouxii* | 61 | 62 |

Yeasts may have one or more genes encoding pyruvate decarboxylase. For example, there is one gene encoding pyruvate decarboxylase in *Candida glabrata* and *Schizosaccharomyces pombe*, while there are three isozymes of pyruvate decarboxylase encoded by the PDC1, PCD5, and PDC6 genes in *Saccharomyces*. In some embodiments, in the present yeast cells at least one PDC gene is inactivated. If the yeast cell used has more than one expressed (active) PDC gene, then each of the active PDC genes may be modified or inactivated thereby producing a pdc-cell. For example, in *S. cerevisiae* the PDC1, PDC5, and PDC6 genes may be modified or inactivated. If a PDC gene is not active under the fermentation conditions to be used then such a gene would not need to be modified or inactivated.

Other target genes, such as those encoding pyruvate decarboxylase proteins having at least 70-75%, at least 75-80%, at least 80-85%, at least 85%-90%, at least 90%-95%, or at least 96%, at least 97%, at least 98%, or at least 99% sequence identity to the pyruvate decarboxylases of SEQ ID NOs: 43, 44, 45, 50, 52, 54, 56, 58, 60, or 62 may be identified in the literature and in bioinformatics databases well known to the skilled person. In addition, the methods described herein for identifying adenylate cyclase homologs can be employed to identify pyruvate decarboxylase genes in microorganisms of interest using the pyruvate decarboxylase sequences provided herein.

Reduction in Pyruvate Decarboxylase Activity and Modifications in Adenylate Cyclase Activity Result in Higher Biomass Production Yeast strains comprising reduced pyruvate decarboxylase activity can be modified to replace the endogenous CYR1 gene with an A1814V variant (SEQ ID NO: 2) or a H1873N variant (SEQ ID NO: 3). The resultant strains can then be transformed to comprise an engineered isobutanol biosynthetic pathway. The resultant engineered isobutanol biosynthetic pathway comprising strains obtained from the transformations can then be monitored over time to measure their biomass yield. In accordance with the present invention, yeast strains comprising reduced pyruvate decarboxylase activity and modified adenylate cyclase activity may have from at least a 10% to a 50% increase in biomass yield, from at least a 20% to a 48% increase in biomass yield, or from at least a 30% to a 45% increase in biomass yield over a strain comprising reduced pyruvate decarboxylase activity.

In accordance with the present invention, yeast strains with modified adenylate cyclase activity may have an increase in adenylate cyclase activity as compared to a strain without modified adenylate cyclase activity, or they may have a decrease in adenylate cyclase activity as compared to a strain without modified adenylate cyclase activity. In some embodiments the modification of adenylate cyclase activity can be a mutation in an adenylate cyclase gene. In a further embodiment, the mutation is in the catalytic domain of an adenylate cyclase gene. In another embodiment, the mutation is in a regulatory region of an adenylate cyclase gene. In some embodiments the adenylate cyclase gene is CYR1. In some embodiments, the modified adenylate cyclase activity is the result of a deletion, disruption, or mutation in a gene that regulates adenylate cyclase activity. In a further embodiment, the regulator of adenylate cyclase activity is selected from the group consisting of GPR1 (SEQ ID NO: 63), GPA2 (SEQ ID NO: 64), RAS1 (SEQ ID NO: 65), and RAS2 (SEQ ID NO: 66) (Kim, J. and M. Johnston. 2006. Two glucose-sensing pathways converge on RGT1 to regulate expression of glucose transporter genes in *Saccharomyces cerevisiae*. J. Biol. Chem. 281:26144-26149). In accordance with the present invention, yeast strains comprising modified adenylate cyclase activity may further comprise a mutation in FLO9, NUM1, PAU10, YGR109W-B, HSP32, ATG13, or combinations thereof.

Polypeptides and Polynucleotides for Use in the Invention

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis. The polypeptides used in this invention comprise full-length polypeptides and fragments thereof.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for the purposes of the invention, as are native or recombinant polypeptides which have been separated, fractionated, or partially or substantially purified by any suitable technique.

A polypeptide of the invention may be of a size of about 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also included as polypeptides of the present invention are derivatives, analogs, or variants of the foregoing polypeptides, and any combination thereof. The terms "active variant," "active fragment," "active derivative," and "analog" refer to polypeptides of the present invention. Variants of polypeptides of the present invention include polypeptides with altered amino acid sequences due to amino acid substitutions, deletions, and/or insertions. Variants may occur naturally or be non-naturally occurring. Non-naturally occurring variants may be produced using art-known mutagenesis techniques. Variant polypeptides may comprise conservative or non-conservative amino acid substitutions, deletions and/or additions. Derivatives of polypeptides of the present invention, are polypeptides which have been altered so as to exhibit additional features not found on the native polypeptide. Examples include fusion proteins. Variant polypeptides may also be referred to herein as "polypeptide analogs." As used herein a "derivative" of a polypeptide refers to a subject polypeptide having one or more residues chemically derivatized by reaction of a functional side group. Also included as "derivatives" are those peptides which contain one or more naturally occurring amino acid derivatives of the twenty standard amino acids. For example, 4-hydroxyproline may be substituted for proline; 5-hydroxylysine may be substituted for lysine; 3-methylhistidine may be substituted for histidine; homoserine may be substituted for serine; and ornithine may be substituted for lysine.

A "fragment" is a unique portion of a polypeptide or other enzyme used in the invention which is identical in sequence to but shorter in length than the parent full-length sequence. A fragment may comprise up to the entire length of the defined sequence, minus one amino acid residue. For example, a fragment may comprise from 5 to 1000 contiguous amino acid residues. A fragment may be at least 5, 10, 15, 20, 25, 30, 40, 50, 60, 75, 100, 150, 250 or at least 500 contiguous amino acid residues in length. Fragments may be preferentially selected from certain regions of a molecule. For example, a polypeptide fragment may comprise a certain length of contiguous amino acids selected from the first 100 or 200 amino acids of a polypeptide as shown in a certain defined sequence. Clearly these lengths are exemplary, and any length that is supported by the specification, including the Sequence Listing, tables, and figures, may be encompassed by the present embodiments.

Alternatively, recombinant variants encoding these same or similar polypeptides can be synthesized or selected by making use of the "redundancy" in the genetic code. Various codon substitutions, such as the silent changes which produce various restriction sites, may be introduced to optimize cloning into a plasmid or viral vector or expression in a host cell system.

Preferably, amino acid "substitutions" are the result of replacing one amino acid with another amino acid having similar structural and/or chemical properties, i.e., conservative amino acid replacements, or they can be result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" are preferably in the range of about 1 to about 20 amino acids, more preferably 1 to 10 amino acids. The variation allowed may be experimentally determined by systematically making insertions, deletions, or substitutions of amino acids in a polypeptide molecule using recombinant DNA techniques and assaying the resulting recombinant variants for activity.

By a polypeptide having an amino acid or polypeptide sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the references sequence.

As a practical matter, whether any particular polypeptide is at least 60%, 65%, 70%, 75%, 80%, 85%, 90%, 95%, 96%, 97%, 98%, or 99% identical to a reference polypeptide can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al., Comp. Appl. Biosci. 6:237-245 (1990). In a sequence alignment, the query and subject sequences are either both nucleotide sequences or both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty-0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case, the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are to be made for the purposes of the present invention.

Polypeptides and other enzymes suitable for use in the present invention and fragments thereof are encoded by polynucleotides. The term "polynucleotide" is intended to encompass a singular nucleic acid as well as plural nucleic acids, and refers to an isolated nucleic acid molecule or construct, e.g., messenger RNA (mRNA), virally-derived RNA, or plasmid DNA (pDNA). A polynucleotide may comprise a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. Polynucleotides according to the present invention further include such molecules produced synthetically. Polynucleotides of the invention may be native to the host cell or heterologous. In addition, a polynucleotide or a nucleic acid may be or may include a regulatory element such as a promoter, ribosome binding site, or a transcription terminator.

In certain embodiments, the polynucleotide or nucleic acid is DNA. In the case of DNA, a polynucleotide comprising a nucleic acid, which encodes a polypeptide normally may include a promoter and/or other transcription or translation control elements operably associated with one or more coding regions. An operable association is when a coding region for a gene product, e.g., a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. Other transcription control elements, besides a promoter, for example enhancers, operators, repressors, and transcription termination signals, can be operably associated with the polynucleotide. Suitable promoters and other transcription control regions are disclosed herein.

A polynucleotide sequence can be referred to as "isolated," in which it has been removed from its native environment. For example, a heterologous polynucleotide encoding a polypeptide or polypeptide fragment having enzymatic activity (e.g., the ability to convert a substrate to xylulose) contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA can be comprised of one or more segments of cDNA, genomic DNA, or synthetic DNA.

The term "gene" refers to a nucleic acid fragment that is capable of being expressed as a specific protein, optionally including regulatory sequences preceding (5' non-coding sequences) and following (3' non-coding sequences) the coding sequence.

As used herein, a "coding region" or "ORF" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' non-translated regions, and the like, are not part of a coding region.

A variety of translation control elements are known to those of ordinary skill in the art. These include, but are not limited to ribosome binding sites, translation initiation and termination codons, and elements derived from viral systems (particularly an internal ribosome entry site, or IRES). In other embodiments, a polynucleotide of the present invention is RNA, for example, in the form of messenger RNA (mRNA). RNA of the present invention may be single stranded or double stranded.

Polynucleotide and nucleic acid coding regions of the present invention may be associated with additional coding regions which encode secretory or signal peptides, which direct the secretion of a polypeptide encoded by a polynucleotide of the present invention.

As used herein, the term "transformation" refers to the transfer of a nucleic acid fragment into the genome of a host organism, resulting in genetically stable inheritance. Host organisms containing the transformed nucleic acid fragments are referred to as "recombinant" or "transformed" organisms.

The term "expression," as used herein, refers to the transcription and stable accumulation of sense (mRNA) or antisense RNA derived from the nucleic acid fragment of the invention. Expression may also refer to translation of mRNA into a polypeptide.

The terms "plasmid," "vector," and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

The term "artificial" refers to a synthetic, or non-host cell derived composition, e.g., a chemically-synthesized oligonucleotide.

As used herein, "native" refers to the form of a polynucleotide, gene, or polypeptide as found in nature with its own regulatory sequences, if present.

The term "endogenous," when used in reference to a polynucleotide, a gene, or a polypeptide refers to a native polynucleotide or gene in its natural location in the genome of an organism, or for a native polypeptide, is transcribed and translated from this location in the genome.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene may be introduced into the host organism by, e.g., gene transfer. A heterologous gene may include a native coding region with non-native regulatory regions that is reintroduced into the native host. A "transgene" is a gene that has been introduced into the genome by a transformation procedure.

"Deletion" or "deleted" or "disruption" or "disrupted" or "elimination" or "eliminated" used with regard to a gene or set of genes describes various activities for example, 1) deleting coding regions and/or regulatory (promoter) regions, 2) inserting exogenous nucleic acid sequences into coding regions and/regulatory (promoter) regions, and 3) altering coding regions and/or regulatory (promoter) regions (for example, by making DNA base pair changes). Such changes would either prevent expression of the protein of interest or result in the expression of a protein that is non-functional/ shows no activity. Specific disruptions may be obtained by random mutation followed by screening or selection, or, in cases where the gene sequences are known, specific disruptions may be obtained by direct intervention using molecular biology methods know to those skilled in the art.

The term "mutation" as used herein indicates any modification of a nucleic acid and/or polypeptide which results in an altered nucleic acid or polypeptide. Mutations include, for example, point mutations, deletions, or insertions of single or multiple residues in a polynucleotide, which includes alterations arising within a protein-encoding region of a gene as well as alterations in regions outside of a protein-encoding sequence, such as, but not limited to, regulatory sequences. A genetic alteration may be a mutation of any type. For instance, the mutation may constitute a point mutation, a frame-shift mutation, an insertion, or a deletion of part or all of a gene. In addition, in some embodiments of the modified microorganism, a portion of the microorganism genome has been replaced with a heterologous polynucleotide. In some embodiments, the mutations are naturally-occurring or spontaneous. In other embodiments, the mutations are the result of treatment with mutagenic agents such as ethyl methanesulfonate or ultraviolet light. In still other embodiments, the mutations in the microorganism genome are the result of genetic engineering.

The term "recombinant genetic expression element" refers to a nucleic acid fragment that expresses one or more specific proteins, including regulatory sequences preceding (5' noncoding sequences) and following (3' termination sequences) coding sequences for the proteins. A chimeric gene is a recombinant genetic expression element. The coding regions of an operon may form a recombinant genetic expression element, along with an operably linked promoter and termination region.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic nucleic acid segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths may have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths may have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 3. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 3

The Standard Genetic Code

|   | T |   |   | C |   |   | A |   |   | G |   |   |
|---|---|---|---|---|---|---|---|---|---|---|---|---|
| T | TTT | Phe | (F) | TCT | Ser | (S) | TAT | Tyr | (Y) | TGT | Cys | (C) |
|   | TTC | Phe | (F) | TCC | Ser | (S) | TAC | Tyr | (Y) | TGC |     |     |
|   | TTA | Leu | (L) | TCA | Ser | (S) | TAA | Ter |     | TGA | Ter |     |
|   | TTG | Leu | (L) | TCG | Ser | (S) | TAG | Ter |     | TGG | Trp | (W) |
| C | CTT | Leu | (L) | CCT | Pro | (P) | CAT | His | (H) | CGT | Arg | (R) |
|   | CTC | Leu | (L) | CCC | Pro | (P) | CAC | His | (H) | CGC | Arg | (R) |
|   | CTA | Leu | (L) | CCA | Pro | (P) | CAA | Gln | (Q) | CGA | Arg | (R) |
|   | CTG | Leu | (L) | CCG | Pro | (P) | CAG | Gln | (Q) | CGG | Arg | (R) |
| A | ATT | Ile | (I) | ACT | Thr | (T) | ATT | Asn | (N) | AGT | Ser | (S) |
|   | ATC | Ile | (I) | ACC | Thr | (T) | AAC | Asn | (N) | AGC | Ser | (S) |
|   | ATA | Ile | (I) | ACA | Thr | (T) | AAA | Lys | (K) | AGA | Arg | (R) |
|   | ATG | Met | (M) | ACG | Thr | (T) | AAG | Lys | (K) | AGG | Arg | (R) |
| G | GTT | Val | (V) | GCT | Ala | (A) | GAT | Asp | (D) | GGT | Gly | (G) |
|   | GTC | Val | (V) | GCC | Ala | (A) | GAC | Asp | (D) | GGC | Gly | (G) |
|   | GTA | Val | (V) | GCA | Ala | (A) | GAA | Glu | (E) | GGA | Gly | (G) |
|   | GTG | Val | (V) | GCG | Ala | (A) | GAG | Glu | (E) | GGG | Gly | (G) |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon-optimization.

Given the large number of gene sequences available for a wide variety of animal, plant and microbial species, it is possible to calculate the relative frequencies of codon usage. Codon usage tables are readily available, for example, at the "Codon Usage Database", and these tables can be adapted in a number of ways. See Nakamura, Y., et al. Nucl. Acids Res. 28:292 (2000). Codon usage tables for yeast, calculated from GenBank Release 128.0 [15 Feb. 2002], are reproduced below as Table 4. This table uses mRNA nomenclature, and so instead of thymine (T) which is found in DNA, the tables use uracil (U) which is found in RNA. The Table has been adapted so that frequencies are calculated for each amino acid, rather than for all 64 codons.

TABLE 4

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |

TABLE 4-continued

Codon Usage Table for *Saccharomyces cerevisiae* Genes

| Amino Acid | Codon | Number | Frequency per thousand |
|---|---|---|---|
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG—Wisconsin Package, available from Accelrys, Inc., San Diego, Calif. In addition, various resources are publicly available to codon-optimize coding region sequences, e.g., the "JAVA Codon Adaptation Tool" and the "Codon optimization tool". Constructing a rudimentary algorithm to assign codons based on a given frequency can also easily be accomplished with basic mathematical functions by one of ordinary skill in the art.

Standard recombinant DNA and molecular cloning techniques used here are well known in the art and are described by Sambrook et al. (Sambrook, Fritsch, and Maniatis, Molecular Cloning: A Laboratory Manual, Second Edition, Cold Spring Harbor Laboratory Press, Cold Spring Harbor, N.Y., 1989) (hereinafter "Maniatis"); and by Silhavy et al. (Silhavy et al., Experiments with Gene Fusions, Cold Spring Harbor Laboratory Press Cold Spring Harbor, N.Y., 1984); and by Ausubel, F. M. et al., (Ausubel et al., Current Protocols in Molecular Biology, published by Greene Publishing Assoc. and Wiley-Interscience, 1987).

Biosynthetic Pathways

Biosynthetic pathways for the production of isobutanol that may be used include those described in U.S. Pat. Nos. 7,851,188 and 7,993,889, which are incorporated herein by reference. Isobutanol pathways are referred to with their lettering in FIG. 1. In one embodiment, the engineered isobutanol biosynthetic pathway comprises the following substrate to product conversions:

a) pyruvate to acetolactate, which may be catalyzed, for example, by acetolactate synthase;
b) acetolactate to 2,3-dihydroxyisovalerate, which may be catalyzed, for example, by acetohydroxy acid reductoisomerase;
c) 2,3-dihydroxyisovalerate to α-ketoisovalerate, which may be catalyzed, for example, by acetohydroxy acid dehydratase;
d) α-ketoisovalerate to isobutyraldehyde, which may be catalyzed, for example, by a branched-chain keto acid decarboxylase; and,
e) isobutyraldehyde to isobutanol, which may be catalyzed, for example, by a branched-chain alcohol dehydrogenase.

In another embodiment, the engineered isobutanol biosynthetic pathway comprises the following substrate to product conversions:

a) pyruvate to acetolactate, which may be catalyzed, for example, by acetolactate synthase;
b) acetolactate to 2,3-dihydroxyisovalerate, which may be catalyzed, for example, by ketol-acid reductoisomerase;
c) 2,3-dihydroxyisovalerate to α-ketoisovalerate, which may be catalyzed, for example, by acetohydroxy acid dehydratase;
h) α-ketoisovalerate to valine, which may be catalyzed, for example, by transaminase or valine dehydrogenase;
i) valine to isobutylamine, which may be catalyzed, for example, by valine decarboxylase;
j) isobutylamine to isobutyraldehyde, which may be catalyzed by, for example, omega transaminase; and,
e) isobutyraldehyde to isobutanol, which may be catalyzed, for example, by a branched-chain alcohol dehydrogenase.

In another embodiment, the engineered isobutanol biosynthetic pathway comprises the following substrate to product conversions:

a) pyruvate to acetolactate, which may be catalyzed, for example, by acetolactate synthase;
b) acetolactate to 2,3-dihydroxyisovalerate, which may be catalyzed, for example, by acetohydroxy acid reductoisomerase;

c) 2,3-dihydroxyisovalerate to α-ketoisovalerate, which may be catalyzed, for example, by acetohydroxy acid dehydratase;

f) α-ketoisovalerate to isobutyryl-CoA, which may be catalyzed, for example, by branched-chain keto acid dehydrogenase;

g) isobutyryl-CoA to isobutyraldehyde, which may be catalyzed, for example, by acetylating aldehyde dehydrogenase; and, e) isobutyraldehyde to isobutanol, which may be catalyzed, for example, by a branched-chain alcohol dehydrogenase.

In another embodiment, the isobutanol biosynthetic pathway comprises the substrate to product conversions shown as steps k, g, and e in FIG. 1.

Engineered biosynthetic pathways for the production of 1-butanol that may be used include those described in U.S. Patent Appl. Pub. No. 2008/0182308, which is incorporated herein by reference. In one embodiment, the 1-butanol biosynthetic pathway comprises the following substrate to product conversions:

a) acetyl-CoA to acetoacetyl-CoA, which may be catalyzed, for example, by acetyl-CoA acetyl transferase;

b) acetoacetyl-CoA to 3-hydroxybutyryl-CoA, which may be catalyzed, for example, by 3-hydroxybutyryl-CoA dehydrogenase;

c) 3-hydroxybutyryl-CoA to crotonyl-CoA, which may be catalyzed, for example, by crotonase;

d) crotonyl-CoA to butyryl-CoA, which may be catalyzed, for example, by butyryl-CoA dehydrogenase;

e) butyryl-CoA to butyraldehyde, which may be catalyzed, for example, by butyraldehyde dehydrogenase; and, f) butyraldehyde to 1-butanol, which may be catalyzed, for example, by butanol dehydrogenase.

Engineered biosynthetic pathways for the production of 2-butanol that may be used include those described in U.S. Pat. No. 8,206,970 and U.S. Patent Appl. Pub. No. 2009/0155870, which are incorporated herein by reference. In one embodiment, the 2-butanol biosynthetic pathway comprises the following substrate to product conversions:

a) pyruvate to α-acetolactate, which may be catalyzed, for example, by acetolactate synthase;

b) α-acetolactate to acetoin, which may be catalyzed, for example, by acetolactate decarboxylase;

c) acetoin to 3-amino-2-butanol, which may be catalyzed, for example, acetonin aminase;

d) 3-amino-2-butanol to 3-amino-2-butanol phosphate, which may be catalyzed, for example, by aminobutanol kinase;

e) 3-amino-2-butanol phosphate to 2-butanone, which may be catalyzed, for example, by aminobutanol phosphate phosphorylase; and, f) 2-butanone to 2-butanol, which may be catalyzed, for example, by butanol dehydrogenase.

In another embodiment, the engineered 2-butanol biosynthetic pathway comprises the following substrate to product conversions:

a) pyruvate to α-acetolactate, which may be catalyzed, for example, by acetolactate synthase;

b) α-acetolactate to acetoin, which may be catalyzed, for example, by acetolactate decarboxylase;

c) acetoin to 2,3-butanediol, which may be catalyzed, for example, by butanediol dehydrogenase;

d) 2,3-butanediol to 2-butanone, which may be catalyzed, for example, by diol dehydratase; and, e) 2-butanone to 2-butanol, which may be catalyzed, for example, by butanol dehydrogenase.

Engineered biosynthetic pathways for the production of 2-butanone that may be used include those described in U.S. Pat. No. 8,206,970 and U.S. Patent Appl. Pub. No. 2009/0155870, which are incorporated herein by reference. In one embodiment, the engineered 2-butanone biosynthetic pathway comprises the following substrate to product conversions:

a) pyruvate to α-acetolactate, which may be catalyzed, for example, by acetolactate synthase;

b) α-acetolactate to acetoin, which may be catalyzed, for example, by acetolactate decarboxylase;

c) acetoin to 3-amino-2-butanol, which may be catalyzed, for example, acetonin aminase;

d) 3-amino-2-butanol to 3-amino-2-butanol phosphate, which may be catalyzed, for example, by aminobutanol kinase; and, e) 3-amino-2-butanol phosphate to 2-butanone, which may be catalyzed, for example, by aminobutanol phosphate phosphorylase.

In another embodiment, the engineered 2-butanone biosynthetic pathway comprises the following substrate to product conversions:

a) pyruvate to α-acetolactate, which may be catalyzed, for example, by acetolactate synthase;

b) α-acetolactate to acetoin which may be catalyzed, for example, by acetolactate decarboxylase;

c) acetoin to 2,3-butanediol, which may be catalyzed, for example, by butanediol dehydrogenase;

d) 2,3-butanediol to 2-butanone, which may be catalyzed, for example, by diol dehydratase.

In one embodiment, the invention produces butanol from plant derived carbon sources, avoiding the negative environmental impact associated with standard petrochemical processes for butanol production. In one embodiment, the invention provides a method for the production of butanol using recombinant industrial host cells comprising an engineered butanol pathway.

In some embodiments, the engineered butanol biosynthetic pathway comprises at least one polynucleotide, at least two polynucleotides, at least three polynucleotides, or at least four polynucleotides that is/are heterologous to the host cell. In embodiments, each substrate to product conversion of an engineered butanol biosynthetic pathway in a recombinant host cell is catalyzed by a heterologous polypeptide. In embodiments, the polypeptide catalyzing the substrate to product conversions of acetolactate to 2,3-dihydroxyisovalerate and/or the polypeptide catalyzing the substrate to product conversion of isobutyraldehyde to isobutanol are capable of utilizing NADH as a cofactor.

The terms "acetohydroxyacid synthase," "acetolactate synthase" and "acetolactate synthetase" (abbreviated "ALS") are used interchangeably herein to refer to an enzyme that catalyzes the conversion of pyruvate to acetolactate and $CO_2$. Example acetolactate synthases are known by the EC number 2.2.1.6 (Enzyme Nomenclature 1992, Academic Press, San Diego). These unmodified enzymes are available from a number of sources, including, but not limited to, *Bacillus subtilis* (GenBank Nos: CAB15618 (SEQ ID NO: 67), Z99122), *Klebsiella pneumoniae* (GenBank Nos: AAA25079, M73842), and *Lactococcus lactis* (GenBank Nos: AAA25161, L16975).

The term "ketol-acid reductoisomerase" ("KARI"), and "acetohydroxy acid isomeroreductase" will be used interchangeably and refer to enzymes capable of catalyzing the reaction of (S)-acetolactate to 2,3-dihydroxyisovalerate. Example KARI enzymes may be classified as EC number EC 1.1.1.86 (Enzyme Nomenclature 1992, Academic Press, San Diego), and are available from a vast array of microorganisms, including, but not limited to, *Escherichia coli* (GenBank Nos: NP_418222, NC_000913), *Saccharomyces cerevisiae* (GenBank Nos: NP_013459, NM_001182244), *Methanococcus maripaludis* (GenBank Nos: CAF30210, BX957220), and *Bacillus subtilis* (GenBank Nos: CAB14789, Z99118). KARIs include *Anaerostipes caccae* KARI variants "K9G9" and "K9D3" (SEQ ID NOs: 68 and 69, respectively). Ketol-acid reductoisomerase (KARI) enzymes are described in U.S. Patent Appl. Pub. Nos. 2008/0261230 A1, 2009/0163376 A1, 2010/0197519 A1, and PCT Appl. Pub. No. WO 2011/041415, which are incorporated herein by reference. Examples of KARIs disclosed therein are those from *Lactococcus lactis, Vibrio cholera, Pseudomonas aeruginosa* PAO1, and *Pseudomonas fluorescens* PF5 variants (SEQ ID NO: 70). In some embodiments, the KARI utilizes NADH. In some embodiments, the KARI utilizes NADPH.

In addition, suitable KARI enzymes include proteins that match the KARI Profile HMM with an E value of $<10^{-3}$ using hmmsearch program in the HMMER package. The theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., J. Mol. Biol. 235: 1501-1531, 1994. A KARI Profile HMM generated from the alignment of the twenty-five KARIs with experimentally verified function is provided in U.S. Patent Appl. Pub. No. 2011/0313206, which is incorporated herein by reference. Further, KARI enzymes that are a member of a clade identified through molecular phylogenetic analysis called the SLSL clade are described in U.S. Patent Appl. Pub. No. 2011/0244536, incorporated herein by reference.

The term "acetohydroxy acid dehydratase" and "dihydroxyacid dehydratase" ("DHAD") refers to an enzyme that catalyzes the conversion of 2,3-dihydroxyisovalerate to α-ketoisovalerate. Example acetohydroxy acid dehydratases are known by the EC number 4.2.1.9. Such enzymes are available from a vast array of microorganisms, including, but not limited to, *E. coli* (GenBank Nos: YP_026248, NC_000913), *S. cerevisiae* (GenBank Nos: NP_012550, NM_001181674), *M. maripaludis* (GenBank Nos: CAF29874, BX957219), *B. subtilis* (GenBank Nos: CAB14105, Z99115), *L. lactis*, and *N. crassa*. U.S. Patent Appl. Pub. No. 2010/0081154, and U.S. Pat. No. 7,851,188, which are incorporated herein by reference, describe dihydroxyacid dehydratases (DHADs), including a DHAD from *Streptococcus mutans* (SEQ ID NO: 71).

The term "branched-chain α-keto acid decarboxylase" or "α-ketoacid decarboxylase" or "α-ketoisovalerate decarboxylase" or "2-ketoisovalerate decarboxylase" ("KIVD") refers to an enzyme that catalyzes the conversion of α-ketoisovalerate to isobutyraldehyde and $CO_2$. Example branched-chain α-keto acid decarboxylases are known by the EC number 4.1.1.72 and are available from a number of sources, including, but not limited to, *Lactococcus* lactis (GenBank Nos: AAS49166, AY548760; CAG34226, AJ746364), *Salmonella typhimurium* (GenBank Nos: NP_461346, NC_003197), *Clostridium acetobutylicum* (GenBank Nos: NP_149189, NC_001988), *M. caseolyticus* (SEQ ID NO: 72), and *L. grayi* (SEQ ID NO: 73).

The term "branched-chain alcohol dehydrogenase" ("ADH") refers to an enzyme that catalyzes the conversion of isobutyraldehyde to isobutanol. Example branched-chain alcohol dehydrogenases are known by the EC number 1.1.1.265, but may also be classified under other alcohol dehydrogenases (specifically, EC 1.1.1.1 or 1.1.1.2). Alcohol dehydrogenases may be NADPH dependent or NADH dependent. Such enzymes are available from a number of sources, including, but not limited to, *S. cerevisiae* (GenBank Nos: NP_010656, NC_001136; NP_014051 NC_001145), *E. coli* (GenBank Nos: NP_417484, NC_000913), *C. acetobutylicum* (GenBank Nos: NP_349892, NC_003030; NP_349891, NC_003030). U.S. Pat. No. 8,188,250 describes SadB, an alcohol dehydrogenase (ADH) from *Achromobacter xylosoxidans* (SEQ ID NO: 74). Alcohol dehydrogenases also include horse liver ADH and *Beijerinkia indica* ADH (SEQ ID NO: 75) (as described by U.S. Patent Appl. Publ. No. 2011/0269199, which is incorporated herein by reference).

The term "butanol dehydrogenase" refers to a polypeptide (or polypeptides) having an enzyme activity that catalyzes the conversion of isobutyraldehyde to isobutanol or the conversion of 2-butanone and 2-butanol. Butanol dehydrogenases are a subset of a broad family of alcohol dehydrogenases. Butanol dehydrogenase may be NAD- or NADP-dependent. The NAD-dependent enzymes are known as EC 1.1.1.1 and are available, for example, from *Rhodococcus ruber* (GenBank Nos: CAD36475, AJ491307). The NADP dependent enzymes are known as EC 1.1.1.2 and are available, for example, from *Pyrococcus furiosus* (GenBank Nos: AAC25556, AF013169). Additionally, a butanol dehydrogenase is available from *Escherichia coli* (GenBank Nos: NP_417484, NC_000913) and a cyclohexanol dehydrogenase is available from *Acinetobacter* sp. (GenBank Nos: AAG10026, AF282240). The term "butanol dehydrogenase" also refers to an enzyme that catalyzes the conversion of butyraldehyde to 1-butanol, using either NADH or NADPH as cofactor. Butanol dehydrogenases are available from, for example, *C. acetobutylicum* (GenBank NOs: NP_149325, NC_001988; note: this enzyme possesses both aldehyde and alcohol dehydrogenase activity); NP_349891, NC_003030; and NP_349892, NC_003030) and *E. coli* (GenBank NOs: NP_417-484, NC_000913).

The term "branched-chain keto acid dehydrogenase" refers to an enzyme that catalyzes the conversion of α-ketoisovalerate to isobutyryl-CoA (isobutyryl-coenzyme A), typically using $NAD^+$ (nicotinamide adenine dinucleotide) as an electron acceptor. Example branched-chain keto acid dehydrogenases are known by the EC number 1.2.4.4. Such branched-chain keto acid dehydrogenases are comprised of four subunits and sequences from all subunits are available from a vast array of microorganisms, including, but not limited to, *B. subtilis* (GenBank Nos: CAB14336, Z99116; CAB14335, Z99116; CAB14334, Z99116; and CAB14337, Z99116) and *Pseudomonas putida* (GenBank Nos: AAA65614, M57613; AAA65615, M57613; AAA65617), M57613); and AAA65618, M57613).

The term "acylating aldehyde dehydrogenase" refers to an enzyme that catalyzes the conversion of isobutyryl-CoA to isobutyraldehyde, typically using either NADH or NADPH as an electron donor. Example acylating aldehyde dehydrogenases are known by the EC numbers 1.2.1.10 and 1.2.1.57. Such enzymes are available from multiple sources, including, but not limited to, *Clostridium beijerinckii* (GenBank Nos: AAD31841, AF157306), *C. acetobutylicum* (GenBank Nos: NP_149325, NC_001988; NP_149199, NC_001988), *P. putida* (GenBank Nos: AAA89106, U13232), and *Thermus thermophilus* (GenBank Nos: YP_145486, NC_006461).

The term "transaminase" refers to an enzyme that catalyzes the conversion of α-ketoisovalerate to L-valine, using either alanine or glutamate as an amine donor. Example transaminases are known by the EC numbers 2.6.1.42 and 2.6.1.66. Such enzymes are available from a number of sources, Examples of sources for alanine-dependent enzymes include, but are not limited to, *E. coli* (GenBank Nos: YP_026231, NC_000913) and *Bacillus lichenifonnis* (GenBank Nos: YP_093743, NC_006322). Examples of sources for glutamate-dependent enzymes include, but are not limited to, *E. coli* (GenBank Nos: YP_026247, NC_000913), *S. cerevisiae* (GenBank Nos: NP_012682, NC_001142) and *Methanobacterium thermoautotrophicum* (GenBank Nos: NP_276546, NC_000916).

The term "valine dehydrogenase" refers to an enzyme that catalyzes the conversion of α-ketoisovalerate to L-valine, typically using NAD(P)H as an electron donor and ammonia as an amine donor. Example valine dehydrogenases are known by the EC numbers 1.4.1.8 and 1.4.1.9 and such enzymes are available from a number of sources, including, but not limited to, *Streptomyces coelicolor* (GenBank Nos: NP_628270, NC_003888) and *B. subtilis* (GenBank Nos: CAB14339, Z99116).

The term "valine decarboxylase" refers to an enzyme that catalyzes the conversion of L-valine to isobutylamine and $CO_2$. Example valine decarboxylases are known by the EC number 4.1.1.14. Such enzymes are found in *Streptomyces*, such as for example, *Streptomyces viridifaciens* (GenBank Nos: AAN10242, AY116644).

The term "omega transaminase" refers to an enzyme that catalyzes the conversion of isobutylamine to isobutyraldehyde using a suitable amino acid as an amine donor. Example omega transaminases are known by the EC number 2.6.1.18 and are available from a number of sources, including, but not limited to, *Alcaligenes denitrificans* (AAP92672, AY330220), *Ralstonia eutropha* (GenBank Nos: YP_294474, NC_007347), *Shewanella oneidensis* (GenBank Nos: NP_719046, NC_004347), and *P. putida* (GenBank Nos: AAN66223, AE016776).

The term "acetyl-CoA acetyltransferase" refers to an enzyme that catalyzes the conversion of two molecules of acetyl-CoA to acetoacetyl-CoA and coenzyme A (CoA). Example acetyl-CoA acetyltransferases are acetyl-CoA acetyltransferases with substrate preferences (reaction in the forward direction) for a short chain acyl-CoA and acetyl-CoA and are classified as E.C. 2.3.1.9 [Enzyme Nomenclature 1992, Academic Press, San Diego]; although, enzymes with a broader substrate range (E.C. 2.3.1.16) will be functional as well. Acetyl-CoA acetyltransferases are available from a number of sources, for example, *Escherichia coli* (GenBank Nos: NP_416728, NC_000913; NCBI (National Center for Biotechnology Information) amino acid sequence, NCBI nucleotide sequence), *Clostridium acetobutylicum* (GenBank Nos: NP_349476.1, NC_003030; NP_149242, NC_001988, *Bacillus subtilis* (GenBank Nos: NP_390297, NC_000964), and *Saccharomyces cerevisiae* (GenBank Nos: NP_015297, NC_001148).

The term "3-hydroxybutyryl-CoA dehydrogenase" refers to an enzyme that catalyzes the conversion of acetoacetyl-CoA to 3-hydroxybutyryl-CoA. 3-Example hydroxybutyryl-CoA dehydrogenases may be reduced nicotinamide adenine dinucleotide (NADH)-dependent, with a substrate preference for (S)-3-hydroxybutyryl-CoA or (R)-3-hydroxybutyryl-CoA. Examples may be classified as E.C. 1.1.1.35 and E.C. 1.1.1.30, respectively. Additionally, 3-hydroxybutyryl-CoA dehydrogenases may be reduced nicotinamide adenine dinucleotide phosphate (NADPH)-dependent, with a substrate preference for (S)-3-hydroxybutyryl-CoA or (R)-3-hydroxybutyryl-CoA and are classified as E.C. 1.1.1.157 and E.C. 1.1.1.36, respectively. 3-Hydroxybutyryl-CoA dehydrogenases are available from a number of sources, for example, *C. acetobutylicum* (GenBank NOs: NP_349314, NC_003030), *B. subtilis* (GenBank NOs: AAB09614, U29084), *Ralstonia eutropha* (GenBank NOs: YP 294481, NC_007347), and *Alcaligenes eutrophus* (GenBank NOs: AAA21973, J04987).

The term "crotonase" refers to an enzyme that catalyzes the conversion of 3-hydroxybutyryl-CoA to crotonyl-CoA and $H_2O$. Example crotonases may have a substrate preference for (S)-3-hydroxybutyryl-CoA or (R)-3-hydroxybutyryl-CoA and may be classified as E.C. 4.2.1.17 and E.C. 4.2.1.55, respectively. Crotonases are available from a number of sources, for example, *E. coli* (GenBank NOs: NP_415911, NC_000913), *C. acetobutylicum* (GenBank NOs: NP_349318, NC_003030), *B. subtilis* (GenBank NOs: CAB13705, Z99113), and *Aeromonas caviae* (GenBank NOs: BAA21816, D88825).

The term "butyryl-CoA dehydrogenase" refers to an enzyme that catalyzes the conversion of crotonyl-CoA to butyryl-CoA. Example butyryl-CoA dehydrogenases may be NADH-dependent, NADPH-dependent, or flavin-dependent and may be classified as E.C. 1.3.1.44, E.C. 1.3.1.38, and E.C. 1.3.99.2, respectively. Butyryl-CoA dehydrogenases are available from a number of sources, for example, *C. acetobutylicum* (GenBank NOs: NP_347102, NC_003030), *Euglena gracilis* (GenBank NOs: Q5EU90), AY741582), *Streptomyces collinus* (GenBank NOs: AAA92890, U37135), and *Streptomyces coelicolor* (GenBank NOs: CAA22721, AL939127).

The term "butyraldehyde dehydrogenase" refers to an enzyme that catalyzes the conversion of butyryl-CoA to butyraldehyde, using NADH or NADPH as cofactor. Butyraldehyde dehydrogenases with a preference for NADH are known as E.C. 1.2.1.57 and are available from, for example, *Clostridium beijerinckii* (GenBank NOs: AAD31841, AF157306) and *C. acetobutylicum* (GenBank NOs: NP_149325, NC_001988).

The term "isobutyryl-CoA mutase" refers to an enzyme that catalyzes the conversion of butyryl-CoA to isobutyryl-CoA. This enzyme uses coenzyme $B_{12}$ as cofactor. Example isobutyryl-CoA mutases are known by the EC number 5.4.99.13. These enzymes are found in a number of *Streptomyces*, including, but not limited to, *Streptomyces* cinnamonensis (GenBank Nos: AAC08713, U67612; CAB59633, AJ246005), *S. coelicolor* (GenBank Nos: CAB70645, AL939123; CAB92663, AL939121), and *Streptomyces avermitilis* (GenBank Nos: NP_824008, NC_003155; NP_824637, NC_003155).

The term "acetolactate decarboxylase" refers to a polypeptide (or polypeptides) having an enzyme activity that catalyzes the conversion of alpha-acetolactate to acetoin. Example acetolactate decarboxylases are known as EC 4.1.1.5 and are available, for example, from *Bacillus subtilis* (GenBank Nos: AAA22223, L04470), *Klebsiella* terrigena (GenBank Nos: AAA25054, L04507) and *Klebsiella pneumoniae* (GenBank Nos: AAU43774, AY722056).

The term "acetoin aminase" or "acetoin transaminase" refers to a polypeptide (or polypeptides) having an enzyme activity that catalyzes the conversion of acetoin to 3-amino-2-butanol. Acetoin aminase may utilize the cofactor pyridoxal 5'-phosphate or NADH (reduced nicotinamide adenine dinucleotide) or NADPH (reduced nicotinamide adenine dinucleotide phosphate). The resulting product may have (R) or (S) stereochemistry at the 3-position. The pyridoxal phosphate-dependent enzyme may use an amino acid such as alanine or glutamate as the amino donor. The NADH- and NADPH-dependent enzymes may use ammonia as a second substrate. A suitable example of an NADH dependent acetoin aminase, also known as amino alcohol dehydrogenase, is described by Ito et al. (U.S. Pat. No. 6,432,688). An example of a pyridoxal-dependent acetoin aminase is the amine:pyruvate aminotransferase (also called amine:pyruvate transaminase) described by Shin and Kim (*J. Org. Chem.* 67:2848-2853 (2002)).

The term "acetoin kinase" refers to a polypeptide (or polypeptides) having an enzyme activity that catalyzes the conversion of acetoin to phosphoacetoin. Acetoin kinase may utilize ATP (adenosine triphosphate) or phosphoenolpyruvate as the phosphate donor in the reaction. Enzymes that catalyze the analogous reaction on the similar substrate dihydroxyacetone, for example, include enzymes known as EC 2.7.1.29 (Garcia-Alles et al. (2004) Biochemistry 43:13037-13046).

The term "acetoin phosphate aminase" refers to a polypeptide (or polypeptides) having an enzyme activity that catalyzes the conversion of phosphoacetoin to 3-amino-2-butanol O-phosphate. Acetoin phosphate aminase may use the cofactor pyridoxal 5'-phosphate, NADH or NADPH. The resulting product may have (R) or (S) stereochemistry at the 3-position. The pyridoxal phosphate-dependent enzyme may use an amino acid such as alanine or glutamate. The NADH and NADPH-dependent enzymes may use ammonia as a second substrate. Although there are no reports of enzymes catalyzing this reaction on phosphoacetoin, there is a pyridoxal phosphate-dependent enzyme that is proposed to carry out the analogous reaction on the similar substrate serinol phosphate (Yasuta et al. (2001) *Appl. Environ. Microbial.* 67:4999-5009.

The term "aminobutanol phosphate phospholyase", also called "amino alcohol O-phosphate lyase", refers to a polypeptide (or polypeptides) having an enzyme activity that catalyzes the conversion of 3-amino-2-butanol O-phosphate to 2-butanone. Amino butanol phosphate phospho-lyase may utilize the cofactor pyridoxal 5'-phosphate. There are reports of enzymes that catalyze the analogous reaction on the similar substrate 1-amino-2-propanol phosphate (Jones et al. (1973) *Biochem J.* 134:167-182). U.S. Patent Appl. Pub. No. 2007/0259410 describes an aminobutanol phosphate phospholyase from the organism *Erwinia carotovora*.

The term "aminobutanol kinase" refers to a polypeptide (or polypeptides) having an enzyme activity that catalyzes the conversion of 3-amino-2-butanol to 3-amino-2butanol O-phosphate. Amino butanol kinase may utilize ATP as the phosphate donor. Although there are no reports of enzymes catalyzing this reaction on 3-amino-2-butanol, there are reports of enzymes that catalyze the analogous reaction on the similar substrates ethanolamine and 1-amino-2-propanol (Jones et al., supra). U.S. Patent Appl. Pub. No. 2009/0155870 describes, in Example 14, an amino alcohol kinase of *Erwinia* carotovora subsp. *Atroseptica*.

The term "butanediol dehydrogenase" also known as "acetoin reductase" refers to a polypeptide (or polypeptides) having an enzyme activity that catalyzes the conversion of acetoin to 2,3-butanediol. Butanediol dehydrogenases are a subset of the broad family of alcohol dehydrogenases. Butanediol dehydrogenase enzymes may have specificity for production of (R)— or (S)-stereochemistry in the alcohol product. (S)-specific butanediol dehydrogenases are known as EC 1.1.1.76 and are available, for example, from *Klebsiella pneumoniae* (GenBank Nos: BBA13085, D86412). (R)-specific butanediol dehydrogenases are known as EC 1.1.1.4 and are available, for example, from *Bacillus cereus* (GenBank Nos. NP_830481, NC_004722; AAP07682, AE017000), and *Lactococcus* lactis (GenBank Nos. AAK04995, AE006323).

The term "butanediol dehydratase", also known as "diol dehydratase" or "propanediol dehydratase" refers to a polypeptide (or polypeptides) having an enzyme activity that catalyzes the conversion of 2,3-butanediol to 2-butanone. Butanediol dehydratase may utilize the cofactor adenosyl cobalamin (also known as coenzyme B12 or vitamin B12; although vitamin B12 may refer also to other forms of cobalamin that are not coenzyme B12). Adenosyl cobalamin-dependent enzymes are known as EC 4.2.1.28 and are available, for example, from *Klebsiella oxytoca* (GenBank Nos: AA08099 (alpha subunit), D45071; BAA08100 (beta subunit), D45071; and BBA08101 (gamma subunit), D45071 (Note all three subunits are required for activity)], and *Klebsiella pneumonia* (GenBank Nos: AAC98384 (alpha subunit), AF102064; GenBank Nos: AAC98385 (beta subunit), AF102064, GenBank Nos: AAC98386 (gamma subunit), AF102064). Other suitable diol dehydratases include, but are not limited to, B12-dependent diol dehydratases available from *Salmonella typhimurium* (GenBank Nos: AAB84102 (large subunit), AF026270; GenBank Nos: AAB84103 (medium subunit), AF026270; GenBank Nos: AAB84104 (small subunit), AF026270); and *Lactobacillus* collinoides (GenBank Nos: CAC82541 (large subunit), AJ297723; GenBank Nos: CAC82542 (medium subunit); AJ297723; GenBank Nos: CAD01091 (small subunit), AJ297723); and enzymes from *Lactobacillus* brevis (particularly strains CNRZ 734 and CNRZ 735, Speranza et al., J. Agric. Food Chem. (1997) 45:3476-3480), and nucleotide sequences that encode the corresponding enzymes. Methods of diol dehydratase gene isolation are well known in the art (e.g., U.S. Pat. No. 5,686, 276).

It will be appreciated that host cells comprising an engineered butanol biosynthetic pathway as provided herein may further comprise one or more additional modifications. In some embodiments, host cells contain a deletion or down-regulation of a polynucleotide encoding a polypeptide that catalyzes the conversion of glyceraldehyde-3-phosphate to glycerate 1,3, bisphosphate. In some embodiments, the enzyme that catalyzes this reaction is glyceraldehyde-3-phosphate dehydrogenase. In some embodiments, the host cells comprise modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 2009/0305363 (incorporated herein by reference). In some embodiments, the host cells comprise modifications that provide for increased carbon flux through an Entner-Doudoroff Pathway or reducing equivalents balance as described in U.S. Patent Appl. Pub. No. 2010/0120105 (incorporated herein by reference). Other modifications include integration of at least one polynucleotide encoding a polypeptide that catalyzes a step in a pyruvate-utilizing biosynthetic pathway. Other modifications include at least one deletion, mutation, and/or substitution in an endogenous polynucleotide encoding a polypeptide having acetolactate reductase activity as described in PCT Publication No. WO 2011/159853 (incorporated herein by reference). In embodiments, the polypeptide having acetolactate reductase activity is YMR226c (SEQ ID NOs: 76) of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity as described in PCT Publication No. WO 2011/159853 (incorporated herein by reference). In embodiments, the polypeptide having aldehyde dehydrogenase activity is ALD6 from *Saccharomyces cerevisiae* (SEQ ID NO: 77) or a homolog thereof.

Recombinant host cells may further comprise (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT1, AFT2, FRA2, GRX3 or CCC1. AFT1 and AFT2 are described in WO 2001/103300, which is incorporated herein by reference. In embodiments, the polypeptide affecting Fe—S cluster biosynthesis is constitutive mutant AFT1 L99A, AFT1 L102A, AFT1 C291F, or AFT1 C293F.

It will also be appreciated that host cells of the present invention may further incorporate one or more modifications associated with improved butanol tolerance, including, but not limited to, those described in U.S. Pat. Nos. 8,455,225; 8,389,252; and U.S. Appn. Pub. Nos. 20100167363; 20100167364; 20100221801; and 20120058541; all of which are herein incorporated by reference. Modifications described therein include at least one genetic modification which increases activity of the high osmolarity/glycerol response pathway, wherein the genetic modification increases activity of a mitogen-activated protein kinase module of the high osmolarity/glycerol response pathway. Also described therein is genetic modification in a gene involved in the general control response to amino acid starvation. In embodiments, such genetic modification is in a gene encoding a protein selected from Gcn1p, Gcn2p, Gcn3p, Gcn4p, Gcn5p, and Gcn20p. Also described is genetic modification which increases activity of the nitrogen starvation-induced filamentous growth response. In embodiments, such genetic modification increases MSS11p activity. Modifications described therein also include at least one genetic modification which increases cell wall integrity pathway activity such as a genetic modification which increases activity of the mitogen-activated protein kinase module of the cell wall integrity pathway. In embodiments, the genetic modification increases SLT2p serine/threonine MAP kinase activity, and, in embodiments, the modification increasing SLT2 serine/threonine MAP kinase activity is overexpression of an SLT2 protein encoding gene. Also described therein are at least one genetic modification that reduces Pdr5p activity or at least one genetic modification that decreases activity of a multidrug resistance ATP-binding cassette transporter protein encoded by a PDR5, CDR1, or BFR1 gene. Modifications described therein also include introduction of a nucleic acid molecule comprising a 3' region or a 5' region of a gene encoding a CAAX protease polypeptide. In embodiments the nucleic acid molecule comprises a 3' region of a gene encoding a CAAX protease polypeptide in *Lactobacillus* or a 5' region of a gene encoding a CAAX protease polypeptide in *Lactobacillus*.

Butanol Production

Disclosed herein are processes suitable for production of butanol from a carbon substrate and employing a microorganism. In some embodiments, microorganisms may comprise an engineered butanol biosynthetic pathway, such as, but not limited to engineered isobutanol biosynthetic pathways disclosed elsewhere herein. The ability to utilize carbon substrates to produce isobutanol can be confirmed using methods known in the art, including, but not limited to those described in U.S. Pat. No. 7,851,188, which is incorporated herein by reference. For example, a specific high performance liquid chromatography (HPLC) method utilized a Shodex SH-1011 column with a Shodex SH-G guard column, both purchased from Waters Corporation (Milford, Mass.), with refractive index (RI) detection. Chromatographic separation was achieved using 0.01 M $H_2SO_4$ as the mobile phase with a flow rate of 0.5 mL/min and a column temperature of 50° C. Isobutanol had a retention time of 46.6 min under the conditions used. Alternatively, gas chromatography (GC) methods are available. For example, a specific GC method utilized an HP-INNOWax column (30 m×0.53 mm id, 1 μm film thickness, Agilent Technologies, Wilmington, Del.), with a flame ionization detector (FID). The carrier gas was helium at a flow rate of 4.5 mL/min, measured at 150° C. with constant head pressure; injector split was 1:25 at 200° C.; oven temperature was 45° C. for 1 min, 45 to 220° C. at 10° C./min, and 220° C. for 5 min; and FID detection was employed at 240° C. with 26 mL/min helium makeup gas. The retention time of isobutanol was 4.5 min.

One embodiment of the invention is directed to a microorganism comprising a pyruvate utilizing biosynthetic pathway, wherein the microorganism further comprises reduced pyruvate decarboxylase activity and modified adenylate cyclase activity. In a further embodiment, the pyruvate utilizing biosynthetic pathway is an engineered butanol production pathway. In some embodiments, the engineered butanol production pathway is an engineered isobutanol production pathway In some embodiments, the engineered isobutanol production pathway comprises the following substrate to product conversions:

(a) pyruvate to acetolactate
(b) acetolactate to 2,3-dihydroxyisovalerate
(c) 2,3-dihydroxyisovalerate to α-ketoisovalerate
(d) α-ketoisovalerate to isobutyraldehyde, and
(e) isobutyraldehyde to isobutanol.

In some embodiments, the microorganism is a member of a genus of *Saccharomyces, Schizosaccharomyces, Hansenula, Candida, Kluyveromyces, Yarrowia, Issatchenkia,* or *Pichia*. In some embodiments, the microorganism is *Saccharomyces cerevisiae.*

In some embodiments, the engineered microorganism contains one or more polypeptides selected from a group of enzymes catalyzing substrate to product conversions having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.1.36, EC 4.2.1.17, EC 4.2.1.55, EC 1.3.1.44, EC 1.3.1.38, EC 5.4.99.13, EC 4.1.1.5, EC 2.7.1.29, EC 1.1.1.76, EC 1.2.1.57, and EC 4.2.1.28.

In some embodiments, the engineered microorganism contains one or more polypeptides selected from acetolactate synthase, acetohydroxy acid isomeroreductase, acetohydroxy acid dehydratase, branched-chain alpha-keto acid decarboxylase, branched-chain alcohol dehydrogenase, acylating aldehyde dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, and butanediol dehydratase.

In some embodiments, the engineered microorganism contains a polypeptide selected from a KARI Profile HMM. A KARI Profile HMM generated from the alignment of the twenty-five KARIs with experimentally verified function is given in U.S. Patent Appl. Pub. No. 2011/0313206, incorporated herein by reference. Suitable KARI enzymes include proteins that match the KARI Profile HMM with an E value of <10$^{-3}$ using hmmsearch program in the HMMER package. The theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., *J. Mol. Biol.* 235: 1501-1531, 1994. Further, KARI enzymes that are a member of a clade identified through molecular phylogenetic analysis called the SLSL clade are described in U.S. Patent Appl. Pub. No. 2011/0244536, incorporated herein by reference. Additional suitable KARI enzymes are described in U.S. Patent Appl. Pub. Nos. 2008/0261230, 2009/0163376, and 2010/0197519, each incorporated herein by reference.

In some embodiments, the carbon substrate is selected from the group consisting of: oligosaccharides, polysaccharides, monosaccharides, and mixtures thereof. In some embodiments, the carbon substrate is selected from the group consisting of: fructose, glucose, lactose, maltose, galactose, sucrose, starch, cellulose, feedstocks, ethanol, lactate, succinate, glycerol, corn mash, sugar cane, biomass, a C5 sugar, such as xylose and arabinose, and mixtures thereof.

In some embodiments, one or more of the substrate to product conversions utilizes NADH or NADPH as a cofactor.

In some embodiments, enzymes from the biosynthetic pathway are localized to the cytosol. In some embodiments, enzymes from the biosynthetic pathway that are usually localized to the mitochondria are localized to the cytosol. In some embodiments, an enzyme from the biosynthetic pathway is localized to the cytosol by removing the mitochondrial targeting sequence. In some embodiments, mitochondrial targeting is eliminated by generating new start codons as described in e.g., U.S. Pat. No. 7,851,188, which is incorporated herein by reference in its entirety. In some embodiments, the enzyme from the biosynthetic pathway that is localized to the cytosol is DHAD. In some embodiments, the enzyme from the biosynthetic pathway that is localized to the cytosol is KARI.

In some embodiments, microorganisms are contacted with carbon substrates under conditions whereby a fermentation product is produced. In some embodiments, the fermentation product is butanol. In some embodiments, the butanol is isobutanol.

In some embodiments, the butanologen produces butanol at least 90% of effective yield, at least 91% of effective yield, at least 92% of effective yield, at least 93% of effective yield, at least 94% of effective yield, at least 95% of effective yield, at least 96% of effective yield, at least 97% of effective yield, at least 98% of effective yield, or at least 99% of effective yield. In some embodiments, the butanologen produces butanol at least 55% to at least 75% of effective yield, at least 50% to at least 80% of effective yield, at least 45% to at least 85% of effective yield, at least 40% to at least 90% of effective yield, at least 35% to at least 95% of effective yield, at least 30% to at least 99% of effective yield, at least 25% to at least 99% of effective yield, at least 10% to at least 99% of effective yield or at least 10% to 100% of effective yield.

Microorganisms

In embodiments, suitable microorganisms include any microorganism useful for genetic modification and recombinant gene expression and that is capable of producing a C3-C6 alcohol by fermentation. In other embodiments, the microorganism is a butanologen. In other embodiments, the butanologen is a yeast host cell. In other embodiments, the yeast host cell can be a member of the genera *Schizosaccharomyces, Issatchenkia, Kluyveromyces, Yarrowia, Pichia, Candida, Hansenula,* or *Saccharomyces*. In other embodiments, the host cell can be *Saccharomyces cerevisiae, Schizosaccharomyces pombe, Kluyveromyces lactis, Kluyveromyces thermotolerans, Kluyveromyces marxianus, Candida glabrata, Candida albicans, Pichia stipitis,* or *Yarrowia lipolytica*. In some embodiments, the host cell is a member of the genera *Saccharomyces*. In some embodiments, the host cell is *Kluyveromyces lactis, Candida glabrata* or *Schizosaccharomyces pombe*. In some embodiments, the host cell is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

In some embodiments, the microorganism expresses an engineered C3-C6 alcohol production pathway. In some embodiments the microorganism is a butanologen that expresses an engineered butanol biosynthetic pathway. In some embodiments, the butanologen is an isobutanologen expressing an engineered isobutanol biosynthetic pathway.

Carbon Substrates

Suitable carbon substrates may include, but are not limited to, monosaccharides such as fructose or glucose, oligosaccharides such as lactose, maltose, galactose, or sucrose, polysaccharides such as starch or cellulose or mixtures thereof and unpurified mixtures from renewable feedstocks such as cheese whey permeate, cornsteep liquor, sugar beet molasses, and barley malt. Other carbon substrates may include ethanol, lactate, succinate, or glycerol.

"Sugar" includes monosaccharides such as fructose or glucose, oligosaccharides such as lactose, maltose, galactose, or sucrose, polysaccharides such as starch or cellulose, C5 sugars such as xylose and arabinose, and mixtures thereof.

Additionally the carbon substrate may also be one-carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., *Microb. Growth C*1 Compd., [Int. Symp.], 7th (1993), 415-32, Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Patent Application Publication No. 2007/0031918 A1, which is incorporated herein by reference. Biomass includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In some embodiments, the carbon substrate is glucose derived from corn. In some embodiments, the carbon substrate is glucose derived from wheat. In some embodiments, the carbon substrate is sucrose derived from sugar cane.

In addition to an appropriate carbon source, fermentation media must contain suitable minerals, salts, cofactors, buffers and other components, known to those skilled in the art, suitable for the growth of the cultures and promotion of an enzymatic pathway described herein.

Fermentation Conditions

Typically cells are grown at a temperature in the range of about 20° C. to about 40° C. in an appropriate medium. Suitable growth media in the present invention include common commercially prepared media such as Sabouraud Dextrose (SD) broth, Yeast Medium (YM) broth, or broth that includes yeast nitrogen base, ammonium sulfate, and dextrose (as the carbon/energy source) or YPD Medium, a blend of peptone, yeast extract, and dextrose in optimal proportions for growing most *Saccharomyces cerevisiae* strains. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2':3'-monophosphate, may also be incorporated into the fermentation medium.

Suitable pH ranges for the fermentation are between pH 3.0 to pH 7.5, where pH 4.5.0 to pH 6.5 is preferred as the initial condition. Fermentations may be performed under aerobic or anaerobic conditions, where anaerobic or microaerobic conditions are preferred.

The amount of butanol produced in the fermentation medium can be determined using a number of methods known in the art, for example, high performance liquid chromatography (HPLC) or gas chromatography (GC).

Industrial Batch and Continuous Fermentations

Isobutanol, or other products, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992).

Isobutanol, or other products, may also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, may be practiced using batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Butanol Isolation from the Fermentation Medium

Bioproduced butanol may be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

Because butanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase may be returned to the first distillation column as reflux. The butanol-rich decanted organic phase may be further purified by distillation in a second distillation column.

The butanol can also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption can also be used to isolate butanol from the fermentation medium. In this method, the fermentation broth containing the butanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, an ester can be formed by contacting the alcohol in a fermentation medium with an organic acid (e.g., fatty acids) and a catalyst capable of esterfiying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant. Other butanol product recovery and/or ISPR methods may be employed, including those described in U.S. Pat. No. 8,101,808, incorporated herein by reference.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

Butanol titer in any phase can be determined by methods known in the art, such as via high performance liquid chromatography (HPLC) or gas chromatography, as described, for example, in U.S. Patent Appl. Pub. No. 2009/0305370, which is incorporated herein by reference.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

The meaning of abbreviations is as follows: "s" means second(s), "min" means minute(s), "h" means hour(s), "psi" means pounds per square inch, "nm" means nanometers, "d" means day(s), "µL" means microliter(s), "mL" means milliliter(s), "L" means liter(s), "mm" means millimeter(s), "nm" means nanometers, "mM" means millimolar, "µM" means micromolar, "M" means molar, "mmol" means millimole(s), "µmol" means micromole(s)", "g" means gram(s), "µg" means microgram(s) and "ng" means nanogram(s), "PCR" means polymerase chain reaction, "OD" means optical density, "$OD_{600}$" means the optical density measured at a wavelength of 600 nm, "cfu" means colony forming units, "kDa" means kilodaltons, "g" means the gravitation constant, "bp" means base pair(s), "kbp" means kilobase pair(s), "% w/v" means weight/volume percent, % v/v" means volume/volume percent, "HPLC" means high performance liquid chromatography, and "GC" means gas chromatography General Methods Materials and methods suitable for the maintenance and growth of yeast cultures are well known in the art. Techniques suitable for use in the following Examples may be found as set out in Yeast Protocols, Second Edition (Wei Xiao, ed; Humana Press, Totowa, N.J. (2006))). All reagents were obtained from Aldrich Chemicals (Milwaukee, Wis.), BD Diagnostic Systems (Sparks, Md.), Life Technologies (Rockville, Md.), Sigma Chemical Company (St. Louis, Mo.), or Teknova (Half Moon Bay, Calif.) unless otherwise specified.

YPD contains per liter: 10 g yeast extract, 20 g peptone, and 20 g dextrose.

YPE contains per liter: 10 g yeast extract, 20 g peptone, and 1% ethanol.

The oligonucleotide primers to use in the following Examples are given in Table 5. All the oligonucleotide primers are synthesized by Sigma-Genosys (Woodlands, Tex.).

The strains referenced in the following Examples are given in Table 6.

TABLE 5

Primers

| SEQ ID NO: | | |
|---|---|---|
| 78 | oBP622 | AATTGGTACCCCAAAAGGAATATTGGGTCAGA |
| 79 | oBP623 | CCATTGTTTAAACGGCGCGCCGGATCCTTTGCGAAACCCTATGCTCTGT |
| 80 | oBP624 | GCAAAGGATCCGGCGCGCCGTTTAAACAATGGAAGGTCGGGATGAGCAT |
| 81 | oBP625 | AATTGGCCGGCCTACGTAACATTCTGTCAACCAA |
| 82 | oBP626 | AATTGCGGCCGCTTCATATATGACGTAATAAAAT |
| 83 | oBP627 | AATTTTAATTAATTTTTTTTCTTGGAATCAGTAC |
| 84 | HY21 | TTAAGGCGCGCCTATTTGTAATACGTATACGAATTCCTTC |
| 85 | HY24 | ACTTAATAACTTTACCGGCTGTTGACATTTTGTTCTTCTTGTTATTGTATTGTGTT |
| 86 | HY25 | AACACAATACAATAACAAGAAGAACAAAATGTCAACAGCCGGTAAAGTTATTAAGT |
| 87 | HY4 | GGAAGTTTAAACACCACAGGTGTTGTCCTCTGAGGACATA |
| 88 | URA3-end F | GCATATTTGAGAAGATGCGGCCAGCAAAAC |
| 89 | oBP636 | CATTTTTTTCCCTCTAAGAAGC |
| 90 | oBP637 | TTTTTGCACAGTTAAACTACCC |
| 91 | oBP691 | AATTGGATCCGCGATCGCGACGTTCTCTCCGTTGTTCAAA |
| 92 | oBP692 | AATTGGCGCGCCATTTAAATATATATGTATATATAACAC |
| 93 | oBP693 | AATTGTTTAAACAAAGGATGATATTGTTCTATTA |
| 94 | oBP694 | AATTGGCCGGCCGCAACGACGACAATGCCAAAC |
| 95 | oBP695 | AATTGCGGCCGCATGACAGGTGAAAGAATTGAAA |
| 96 | oBP696 | AATTTTAATTAAACGGGCATCTTATAGTGTCGTT |
| 97 | HY16 | TTAAGGCGCGCCCCGCACGCCGAAATGCATGCAAGTAACC |
| 98 | HY19 | ACTTAATAACTTTACCGGCTGTTGACATTTTGATTGATTTGACTGTGTTATTTTGC |
| 99 | HY20 | GCAAAATAACACAGTCAAATCAATCAAAATGTCAACAGCCGGTAAAGTTATTAAGT |
| 100 | oBP730 | TTGCTCCAAAGAGATGTCTTTA |
| 101 | oBP731 | TGTTCCCACAATCTATTACCTA |
| 102 | HY31 | GCCGACTTTATGGCGAAGAAGTTTGCTCTTGATC |
| 103 | oBP562 | AATTGTTTAAACATGTATACAGTAGGTGACTATC |
| 104 | oBP563 | AATCATAAATCATAAGAAATTCGCTTATCAGCTCTTGTTTTGTTCTGCA |
| 105 | oBP564 | TTATTTGCAGAACAAAACAAGAGCTGATAAGCGAATTTCTTATGATTTA |
| 106 | oBP565 | AATTGGCCGGCCAAAAAAAGCATGCACGTATACA |

TABLE 5-continued

Primers

| SEQ ID NO: | | |
|---|---|---|
| 107 | oBP505 | AATTGAGCTCACTGTAGCCCTAGACTTGATAG |
| 108 | oBP506 | AATTGGCGCGCCTGTATATGAGATAGTTGATTGTA |
| 109 | oBP507 | AATTTTAATTAAGTCTAGGTTCTTTGGCTGTTCAA |
| 110 | oBP508 | AATTGTCGACTTTAGAAGTGTCAACAACGTATC |
| 111 | oBP674 | AATTGGCGCGCCAATTACCGTCGCTCGTGATTTG |
| 112 | oBP675 | AATTGTTTAAACTTGAATATGTATTACTTGGTTA |
| 113 | oBP821 | AATTGTTTAAACTAAGCGAATTTCTTATGATTTATG |
| 114 | oBP484 | AATTGGCCGGCCAAAAAAAGCATGCACGTATACA |
| 115 | oBP822 | AATTGCGGCCGCGTGCCTCATCTATATTTCTGAAATC |
| 116 | oBP823 | AATTTTAATTAATCAGCTCTTGTTTTGTTCTGCAAAT |
| 117 | oBP828 | AATTGTTTAAACATGTATACCGTAGGACAGTACTTG |
| 118 | oBP829 | AATTGTTTAAACTTAAGAGTTTTGCTTAGATAAGG |
| 126 | FBAp-F | CTACAATCAACAGATCGCTTCAATTACGC |
| 127 | oBP830 | TATTTAATAATAAAAATCATAAATCATAAGAAATTCGCTTAAGAGTTTTGCTTAGATAAG |

TABLE 6

Strains referenced in the Examples

| Strain Name | Genotype | Description |
|---|---|---|
| PNY2211 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t | PCT Publication No. WO2012033832, incorporated herein by reference |
| PNY1528 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Ll(y)-ADH1t yprcΔ15Δ::P[PDC5]-ADH|adh_Hl-ADH1t | Herein |
| PNY1530 | PNY1528 with plasmid pYZ107F-OLE1p containing (P[ILV5]-KARI|ilvC_Ll-ILV5t P[OLE1]-DHAD|ilvD_Sm-FBA1t) | Herein |
| PNY1556 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Lg(y)-ADH1t yprcΔ15Δ::P[PDC5]-ADH|adh_Hl-ADH1t | Herein |
| PNY1567, PNY1568 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Lg(y)-ADH1t yprcΔ15Δ::P[PDC5]-ADH|adh_Hl-ADH1t cyr1::CYR1(3'y) | Herein |
| PNY1569, PNY1570 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Lg(y)-ADH1t yprcΔ15Δ::P[PDC5]-ADH|adh_Hl-ADH1t cyr1::cyr1 H1873N(3'y) | Herein |
| PNY1571, PNY1572 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Lg(y)-ADH1t yprcΔ15Δ::P[PDC5]-ADH|adh_Hl-ADH1t cyr1::cyr1 A1814V(3'y) | Herein |
| PNY1579, PNY1580, PNY1581 | PNY1556 with plasmid pYZ107F-OLE1p containing (P[ILV5]-KARI|ilvC_Ll-ILV5t P[OLE1]-DHAD|ilvD_Sm-FBA1t) | Herein |
| PNY1582, PNY1583, PNY1584, PNY1585, PNY1586, PNY1587 | PNY1567 or PNY1568 with plasmid pYZ107F-OLE1p containing (P[ILV5]-KARI|ilvC_Ll-ILV5t P[OLE1]-DHAD|ilvD_Sm-FBA1t) | Herein |
| PNY1588, PNY1589, PNY1590, PNY1591, PNY1592, PNY1593 | PNY1569 or PNY1570 with plasmid pYZ107F-OLE1p containing (P[ILV5]-KARI|ilvC_Ll-ILV5t P[OLE1]-DHAD|ilvD_Sm-FBA1t) | Herein |
| PNY1594, PNY1595, PNY1596, | PNY1571 or PNY1572 with plasmid pYZ107F-OLE1p containing (P[ILV5]- | Herein |

TABLE 6-continued

Strains referenced in the Examples

| Strain Name | Genotype | Description |
|---|---|---|
| PNY1597, PNY1598, PNY1599 | KARI\|ilvC_Ll-ILV5t P[OLE1]-DHAD\|ilvD_Sm-FBA1t) | |

Example 1

Construction of Strains PNY1528 and PNY1530

Construction of PNY1528 (hADH Integrations in PNY2211)

PNY1528 was constructed in strain PNY2211 (described in PCT Publication No. WO 2012/033832, incorporated herein by reference). Deletions/integrations were created by homologous recombination with PCR products containing regions of homology upstream and downstream of the target region and the URA3 gene for selection of transformants. The URA3 gene was removed by homologous recombination to create a scarless deletion/integration.

The scarless deletion/integration procedure was adapted from Akada et al., Yeast, 23:399 (2006). The PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (each approximately 100 to 500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

The integration cassettes were constructed in plasmid pUC19-URA3MCS (SEQ ID NO: 119). The vector is pUC19 based and contains the sequence of the URA3 gene from Saccaromyces cerevisiae CEN.PK 113-7D situated within a multiple cloning site (MCS). pUC19 contains the pMB1 replicon and a gene coding for beta-lactamase for replication and selection in Escherichia coli. In addition to the coding sequence for URA3, the sequences from upstream (250 bp) and downstream (150 bp) of this gene are present for expression of the URA3 gene in yeast.

YPRCΔ15 Deletion and Horse Liver Adh Integration

The YPRCΔ15 locus was deleted and replaced with the horse liver adh gene, codon-optimized for expression in Saccharomyces cerevisiae, along with the PDC5 promoter region (538 bp) from Saccharomyces cerevisiae and the ADH1 terminator region (316 bp) from Saccharomyces cerevisiae. The scarless cassette for the YPRCΔ15 deletion-P[PDC5]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCΔ15 Fragment A was amplified from genomic DNA with primer oBP622 (SEQ ID NO: 78), containing a KpnI restriction site, and primer oBP623 (SEQ ID NO: 79), containing a 5' tail with homology to the 5' end of YPRCΔ15 Fragment B. YPRCΔ15 Fragment B was amplified from genomic DNA with primer oBP624 (SEQ ID NO: 80), containing a 5' tail with homology to the 3' end of YPRCΔ15 Fragment A, and primer oBP625 (SEQ ID NO: 81), containing a FseI restriction site. PCR products were purified with a PCR Purification kit (Qiagen). YPRCΔ15 Fragment A—YPRCΔ15 Fragment B was created by overlapping PCR by mixing the YPRCΔ15 Fragment A and YPRCΔ15 Fragment B PCR products and amplifying with primers oBP622 (SEQ ID NO: 78) and oBP625 (SEQ ID NO: 81). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 82), containing a NotI restriction site, and primer oBP627 (SEQ ID NO: 83), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 84), containing an AscI restriction site, and primer HY24 (SEQ ID NO: 85), containing a 5' tail with homology to the 5' end of adh_H1(y). adh_H1(y)-ADH1t was amplified from pBP915 (SEQ ID NO: 120) with primers HY25 (SEQ ID NO: 86), containing a 5' tail with homology to the 3' end of P[PDC5], and HY4 (SEQ ID NO: 87), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 84) and HY4 (SEQ ID NO: 87). The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 78) and oBP627 (SEQ ID NO: 83).

Competent cells of PNY2211 were made and transformed with the YPRCΔ15 deletion-P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30° C. Transformants were screened for by PCR with primers URA3-end F (SEQ ID NO: 88) and oBP637 (SEQ ID NO: 90). Correct transformants were grown in YPE (1% ethanol) and plated on synthetic complete medium supplemented with 1% ethanol and containing 5-fluoro-orotic acid (0.1%) at 30° C. to select for isolates that lost the URA3 marker. The deletion of YPRCΔ15 and integration of P[PDC5]-adh_HL(y)-ADH1t were confirmed by PCR with external primers oBP636 (SEQ ID NO: 89) and oBP637 (SEQ ID NO: 90) using genomic DNA prepared with a YeaStar Genomic DNA kit (Zymo Research). A correct isolate of the following genotype was selected for further modification: CEN.PK 113-7D MATa ura3Δ::loxP his3Δ. pdc6Δ. pdc1Δ::P[PDC1]-DHAD|ilvD_Sm-PDC1t-P [FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t yprcΔ15Δ::P[PDC5]-ADH|adh_H1-ADH1t.

Horse Liver Adh Integration at fra2Δ

The horse liver adh gene, codon-optimized for expression in *Saccharomyces cerevisiae*, along with the PDC1 promoter region (870 bp) from *Saccharomyces cerevisiae and the ADH*1 terminator region (316 bp) from *Saccharomyces cerevisiae*, was integrated into the site of the fra2 deletion in the PNY2211 variant with adh_H1(y) integrated at YPRCΔ15. The scarless cassette for the fra2Δ-P[PDC1]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 95), containing a NotI restriction site, and primer oBP696 (SEQ ID NO: 96), containing a PadI restriction site. The fra2Δ Fragment C PCR product was digested with NotI and PadI and ligated with T4 DNA ligase into the corresponding sites of pUC19-URA3MCS. fra2Δ Fragment B was amplified from genomic DNA with primer oBP693 (SEQ ID NO: 93), containing a PmeI restriction site, and primer oBP694 (SEQ ID NO: 94), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 91), containing BamHI and AsiSI restriction sites, and primer oBP692 (SEQ ID NO: 92), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 97), containing an AscI restriction site, and primer HY19 (SEQ ID NO: 98), containing a 5' tail with homology to the 5' end of adh_H1(y). adh_H1(y)-ADH1t was amplified from pBP915 with primers HY20 (SEQ ID NO: 99), containing a 5' tail with homology to the 3' end of P[PDC1], and HY4 (SEQ ID NO: 87), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)-ADH1t PCR products and amplifying with primers HY16 (SEQ ID NO: 97) and HY4 (SEQ ID NO: 87). The resulting PCR product was digested with AscI and PmeI and ligated with T4 DNA ligase into the corresponding sites of the plasmid containing fran Fragments ABC. The entire integration cassette was amplified from the resulting plasmid with primers oBP691 (SEQ ID NO: 91) and oBP696 (SEQ ID NO: 96).

Competent cells of the PNY2211 variant with adh_H1(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30° C. Transformants were screened for by PCR with primers URA3-end F (SEQ ID NO: 88) and oBP731 (SEQ ID NO: 101). Correct transformants were grown in YPE (1% ethanol) and plated on synthetic complete medium supplemented with 1% ethanol and containing 5-fluoro-orotic acid (0.1%) at 30° C. to select for isolates that lost the URA3 marker. The integration of P[PDC1]-adh_HL(y)-ADH1t was confirmed by colony PCR with internal primer HY31 (SEQ ID NO: 102) and external primer oBP731 (SEQ ID NO: 101) and PCR with external primers oBP730 (SEQ ID NO: 100) and oBP731 (SEQ ID NO: 101) using genomic DNA prepared with a YeaStar Genomic DNA kit (Zymo Research). A correct isolate of the following genotype was designated PNY1528: CEN.PK 113-7D MATa ura34:: loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_H1-ADH1t adh1Δ::UAS(PGK1)P[FBA1]-kivD_Ll(y)-ADH1t yprcΔ15Δ::P[PDC5]-ADH|adh_H1-ADH1t.

Construction of PNY1530

PNY1530 was constructed by transforming PNY1528 with plasmid pYZ107F-OLE1p (SEQ ID NO: 121) using a Frozen-EZ Yeast Transformation II kit (Zymo Research; Orange, Calif.). Plasmid pYZ107F-OLE1p (SEQ ID NO: 121) was constructed to contain a chimeric gene having the coding region of the ilvD gene from *Streptococcus mutans* (nt position 5356-3644) expressed from the *Saccharomyces cerevisiae* OLE1 promoter (nt 5961-5366) and followed by the FBA1 terminator (nt 3611-3299) for expression of DHAD, and a chimeric gene having the coding region of the ilvC gene from *Lactococcus lactis* (nt 1628-2650) expressed from the *Saccharomyces cerevisiae* ILV5 promoter (nt 434-1614) and followed by the ILV5 terminator (nt 2664-3286) for expression of KARI.

Example 2

Selection for Isobutanol Tolerance

Cultures of PNY1530 were subjected to five rounds of selection in increasing concentrations of isobutanol. The first round of isobutanol selection was initiated by growing PNY1530 to $OD_{600}$=1.8 in 100 ml of SEU culture medium (yeast nitrogen base supplemented with Sigma yeast synthetic dropout medium without uracil (Sigma Y1501) and with 0.2% ethanol). The cells were centrifuged, resuspended in 100 ml of fresh culture medium and grown for several hours to approximately 3 $OD_{600}$ units. The culture was centrifuged and resuspended at $OD_{600}$=100 (approximately $5\times10^8$ cfu/ml) in 3 ml of culture medium without ethanol. A small sample was removed from the cell suspension for a viable cell count, and the remaining cell suspension was divided into three cultures containing 1.5% isobutanol, 1.7% isobutanol or 2.0% isobutanol. Each culture was incubated at 30° C. on a roller drum for 24 hours. The cultures were then centrifuged, and the cell pellets were each resuspended in 1 ml of culture medium without isobutanol or ethanol. Small samples were removed from the cultures for viable cell counts, and the remaining portion of each cell suspension (approximately 975 µl) was inoculated into 10 ml of SEU culture medium. The cultures were incubated at 30° C. with shaking. In general, each subsequent round of isobutanol selection was initiated with cells that had survived the highest level of isobutanol selection in the previous round of exposure.

Increased numbers of survivors were observed following each exposure to isobutanol (Table 7). For example, only 1.8% of the cells survived 24 hour exposure to 2.0% isobutanol during Selection I whereas 100% of the population survived 24 hour exposure to 2.0% isobutanol during Selection IV. Similarly, no survivors were detected following exposure to 2.7% isobutanol during Selection II whereas 0.004% of the evolved population survived exposure to 2.7% isobutanol during Selection V. Hence, repeated isobutanol selection followed by growth of survivors resulted in an evolved cell population that was better able to survive exposure to isobutanol.

TABLE 7

Evolving isobutanol tolerance in the isobutanologen PNY1530

| | Percent Survival[1] | | | | |
|---|---|---|---|---|---|
| Concentration[2] | Selection I | Selection II | Selection III | Selection IV | Selection V |
| 1.5% Isobutanol | 73 | | | | |
| 1.7% Isobutanol | 53 | | | | |
| 2.0% Isobutanol | 1.8 → | 12 → | 21 | 100 | |
| 2.2% Isobutanol | | | 0.8 | 45 | |
| 2.5% Isobutanol | | 0.0003 | 0.0006 → | 14 → | 4.5 |
| 2.7% Isobutanol | | ND[3] | | | 0.004 |
| 3.0% Isobutanol | | | | | ND |

[1]The arrow (→) indicates survivors that were used to initiate the next round of isobutanol selection.
[2]Calculated concentrations
[3]Not detected.

Example 3

Selection for Growth in the Presence of Isobutanol by Serial Passage

A population of cells that had been evolved through four isobutanol exposures (Selection IV, Example 2) was repeatedly sub-cultured in growth medium supplemented with glucose and isobutanol to select for cells that were better able to utilize glucose in the presence of isobutanol.

A population of cells that had survived 24 hour exposure to 2.5% isobutanol during Selection IV (see Table 7) was diluted into SEGU culture medium (SEU with 0.2% glucose) to $OD_{600}$=0.8. The diluted cell suspension was divided into 1.5 ml cultures, dispensed into 2 ml sterile screw cap tubes and supplemented with various concentrations of isobutanol. The cultures were incubated at 30° C. on a roller drum. After 24 hours, the cultures were diluted 1:2 with the SEGU culture medium comprising the same amount of isobutanol as the previous culture. After an additional 24 hours, 0.5% isobutanol was found to be the highest concentration that permitted growth. The 0.5% culture was serially sub-cultured 10 times by diluting the culture to approximately $OD_{600}$=0.5 in SEGU culture medium containing 0.5% isobutanol and incubating the diluted culture at 30° C. for 24 to 48 hours before diluting the culture again.

After the last sub-culture, the 0.5% culture was plated and colonies were inoculated into SEGU in microtiter plates. The Bioscreen C growth curve machine was used to identify variants with better growth characteristics than strain PNY1530. The growth rates of 188 isolates in SEGU culture medium without added isobutanol were compared to each other and to PNY1530, and 30 isolates were chosen for further testing in the BioScreen by culturing the isolates in SEGU with 0%, 1% or 2% isobutanol. Growth of the 30 isolates for 24 hours was analyzed by determining the difference between initial $OD_{600}$ and final $OD_{600}$ (DOD) for each isolate. Isolate 20 and isolate 21 had the highest levels of growth in both 1% and 2% isobutanol (Table 8). In addition, isolate 22 had higher growth in 2% isobutanol than all of the other isolates except 20 and 21. Isolates 20, 21 and 22 were chosen for additional characterization. However, isolate 20 failed to grow well in subsequent flask experiments. Therefore, further experimentation proceeded with isolate 21 (PNY0314) and isolate 22 (PNY0315).

TABLE 8

BioScreen C growth of evolved PNY1530 isolates in 0%, 1%, or 2% isobutanol

| | ΔOD[1] | | |
|---|---|---|---|
| Isolate | 0% Isobutanol | 1% Isobutanol | 2% Isobutanol |
| 1 | 0.401 | 0.142 | 0.057 |
| 2 | 0.354 | 0.137 | 0.079 |
| 3 | 0.394 | 0.12 | 0.035 |
| 4 | 0.329 | 0.143 | 0.093 |
| 5 | 0.383 | 0.125 | 0.087 |
| 6 | 0.328 | 0.151 | 0.097 |
| 7 | 0.357 | 0.12 | 0.085 |
| 8 | 0.382 | 0.125 | 0.09 |
| 9 | 0.390 | 0.171 | 0.063 |
| 10 | 0.325 | 0.157 | 0.094 |
| 11 | 0.340 | 0.138 | 0.033 |
| 12 | 0.313 | 0.121 | 0.057 |
| 13 | 0.274 | 0.12 | 0.008 |
| 14 | 0.282 | 0.12 | 0.014 |
| 15 | 0.183 | 0.113 | 0.018 |
| 16 | 0.261 | 0.124 | 0.067 |
| 17 | 0.270 | 0.122 | 0.093 |
| 18 | 0.260 | 0.157 | 0.089 |
| 19 | 0.246 | 0.135 | 0.051 |
| 20 | 0.236 | 0.147 | 0.149 |
| 21 | 0.274 | 0.126 | 0.131 |
| 22 | 0.215 | 0.079 | 0.114 |
| 23 | 0.178 | 0.089 | 0.03 |
| 24 | 0.174 | 0.06 | 0.047 |
| 25 | 0.186 | 0.089 | 0.058 |
| 26 | 0.187 | 0.089 | 0.047 |
| 27 | 0.143 | 0.081 | 0.065 |
| 28 | 0.192 | 0.071 | 0.021 |
| 29 | 0.198 | 0.114 | 0.008 |
| 30 | 0.184 | 0.106 | 0.047 |
| PNY1530 | 0.069 | 0.088 | 0.034 |

[1]ΔOD = (initial $OD_{600}$ − final $OD_{600}$)

Example 4

Glucose Utilization by PNY1530, PNY0314, and PNY0315 in Culture Medium with 1% Isobutanol The abilities of PNY0314, PNY0315 and PNY1530 to metabolize glucose in the presence of 1% isobutanol were compared in a shake flask experiment.

Each strain was grown overnight in 200 ml of SEGU at 30° C. with shaking in non-vented 500 ml culture flasks, centrifuged, and then resuspended to $OD_{600}$=5.9-6.0 in SEU with 20 g/L glucose. Samples (500 μl) were withdrawn from the cultures at 2 hour intervals for glucose analysis. The samples were mixed with 500 μl of 10% TCA, centrifuged and analyzed using an YSI 2700 Select analyzer with probe assembly Part #110923.

During the first 7 to 8 hours of the experiment, PNY0314 and PNY0315 utilized glucose at rates (0.71 and 0.80 g/gdcw/h respectively) that were comparable to or slightly higher than PNY1530 (0.68 g/gdcw/h) in the absence of isobutanol (data not shown). During the same time, PNY0314 and PNY0315 metabolized glucose in cultures supplemented with 1% isobutanol at rates that were approximately 30% higher than PNY1530 (Table 9).

TABLE 9

Glucose Utilization by PNY1530, PNY0314 and PNY0315 in cultures containing 1% Isobutanol.

| Time (hr) | Glucose Remaining[1] (g/L) | | |
|---|---|---|---|
| | PNY1530 | PNY0314 | PNY0315 |
| 0.0 | 20.47 | 20.47 | 20.47 |
| 1.0 | 20.47 | 20.26 | 20.06 |
| 3.0 | 18.82 | 18.64 | 18.29 |
| 5.0 | 17.60 | 16.80 | 16.67 |
| 7.0 | 17.27 | 15.86 | 15.64 |
| 24.0 | 15.53 | 12.76 | 13.29 |
| Glucose Utilization Rate[2] (g/gdcw/h) | 0.242 | 0.313 | 0.322 |

[1]Average of two cultures for each strain
[2]Rates calculated for time 1 to 7 hours.

Example 5

Fermentation with PNY1530, PNY0314 and PNY0315

Figure 2:
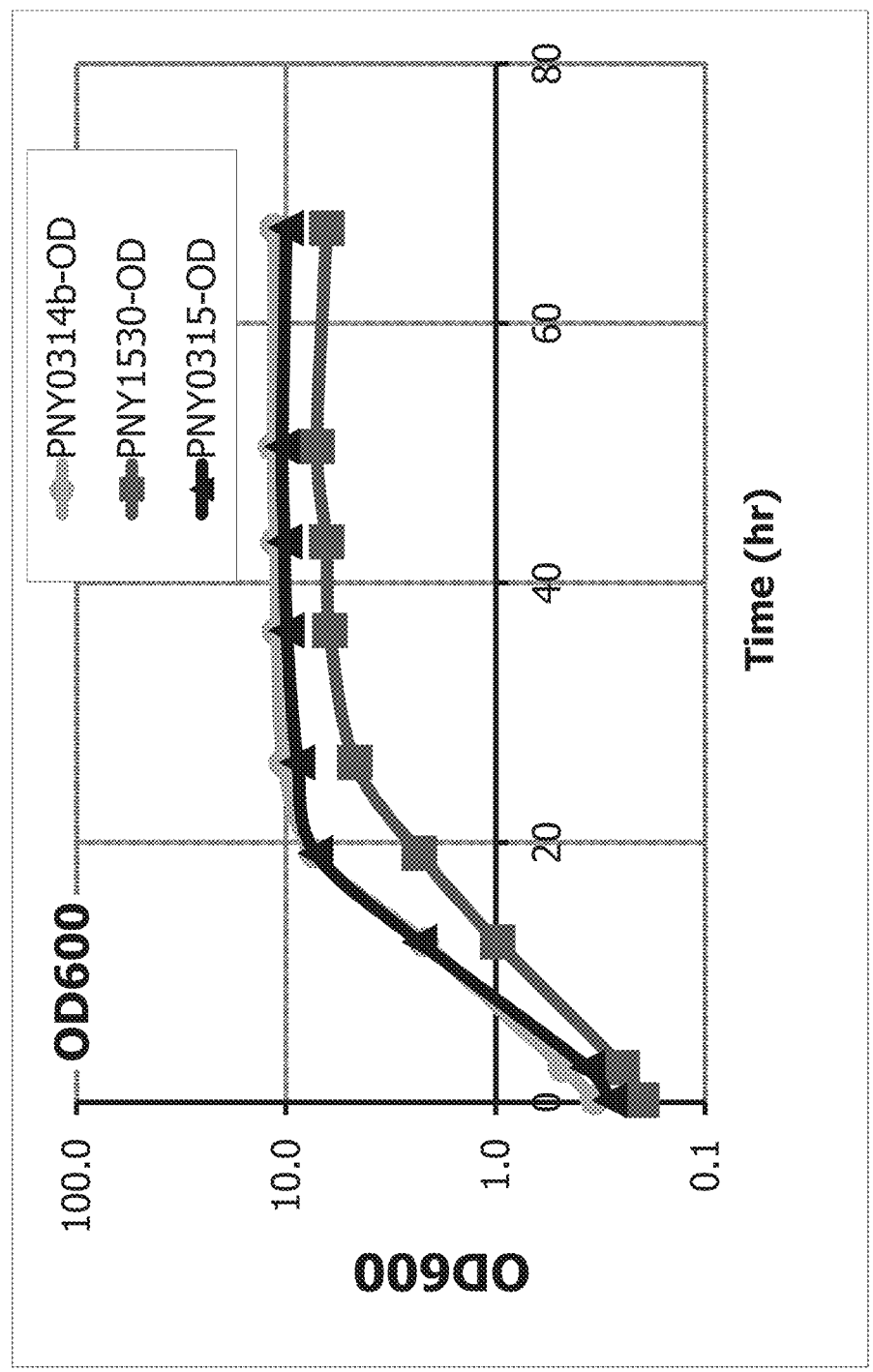
FIG. 2 depicts growth curves of evolved isobutanol tolerant strains compared to their non-evolved parental strain.
Figure 3:
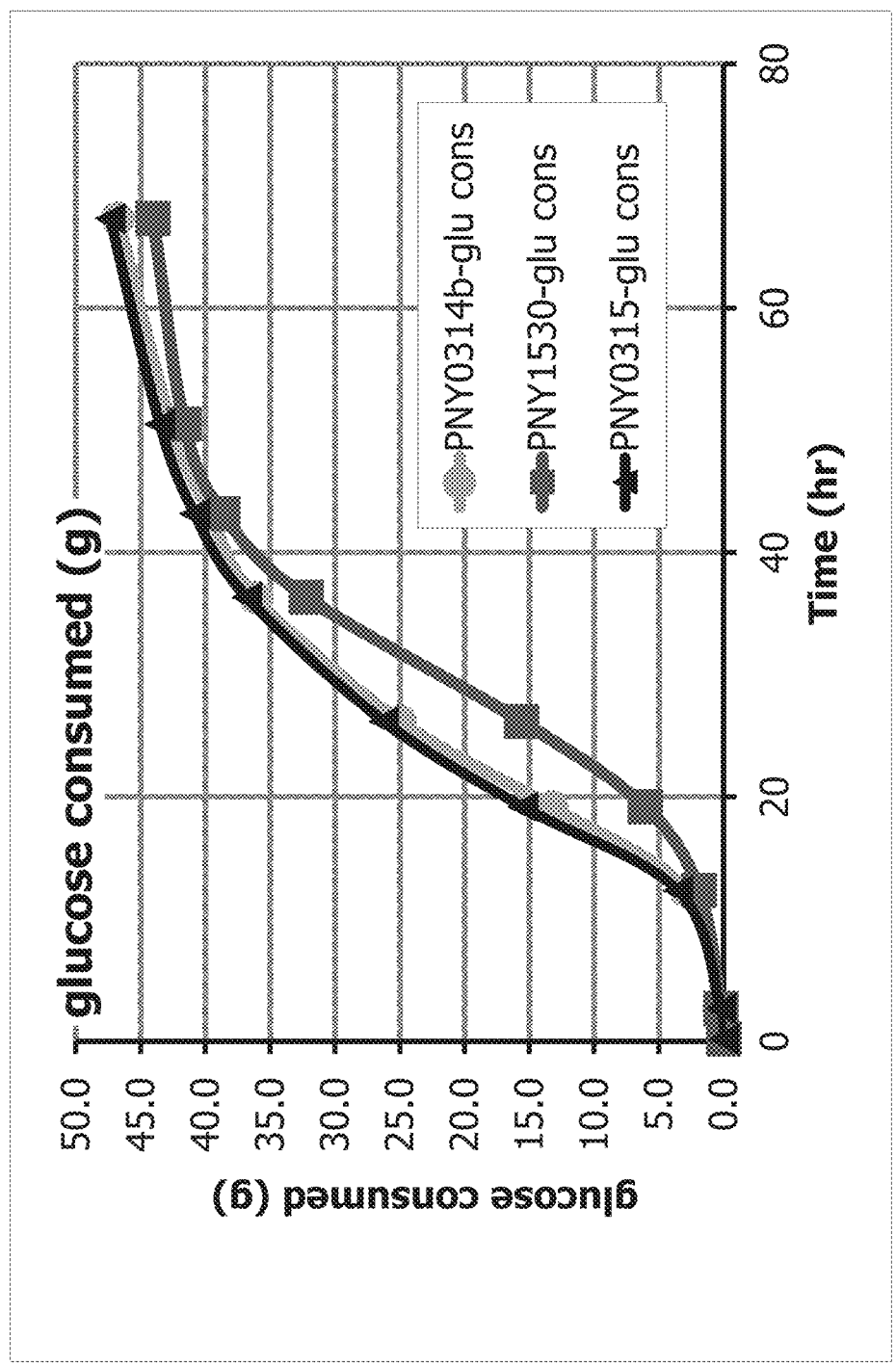
FIG. 3 depicts a graph of glucose consumption by evolved isobutanol tolerant strains compared to their non-evolved parental strain.
Figure 4:
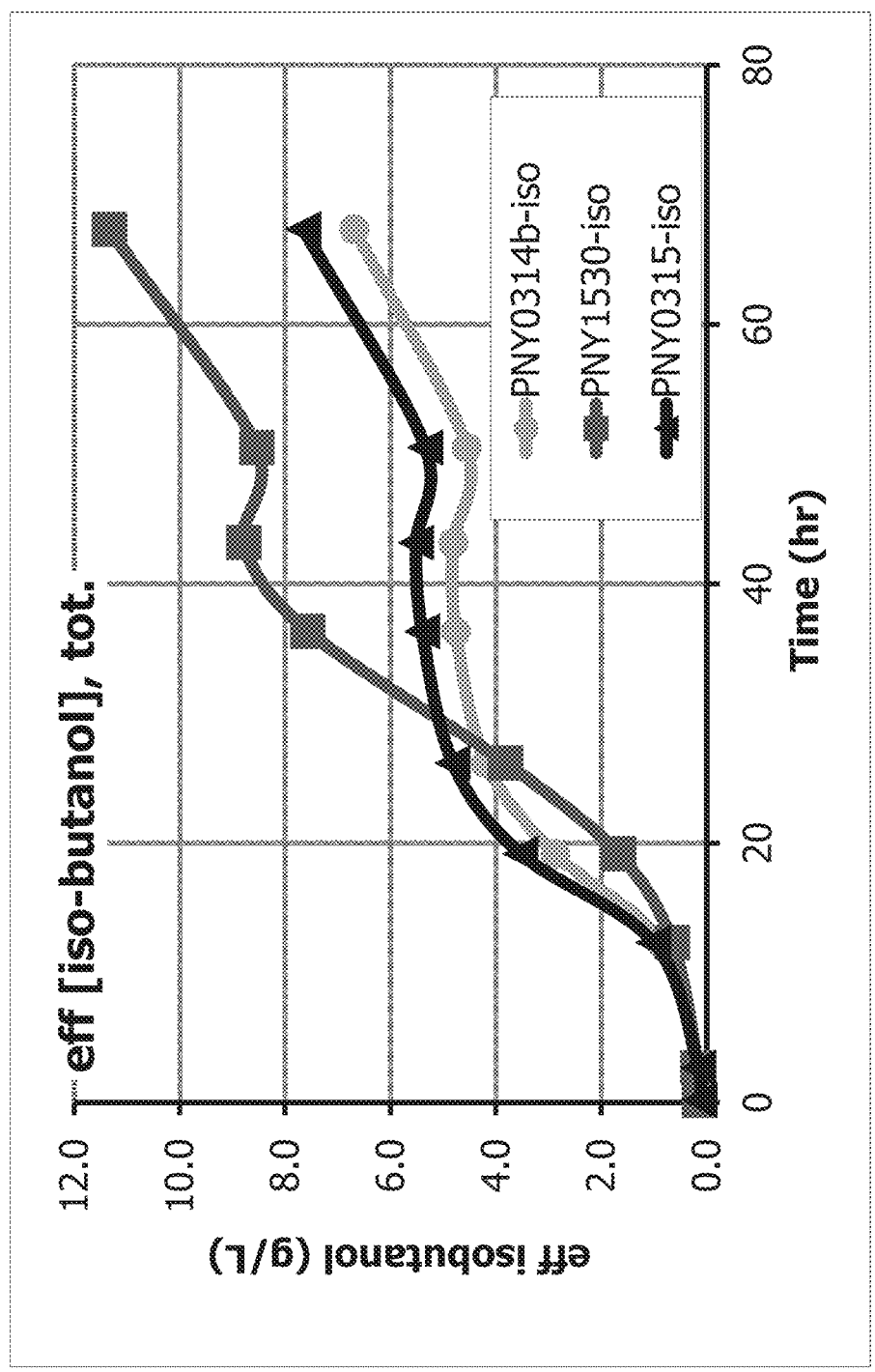
FIG. 4 depicts a graph of isobutanol production in evolved isobutanol tolerant strains compared to their non-evolved parental strain.
Figure 5:
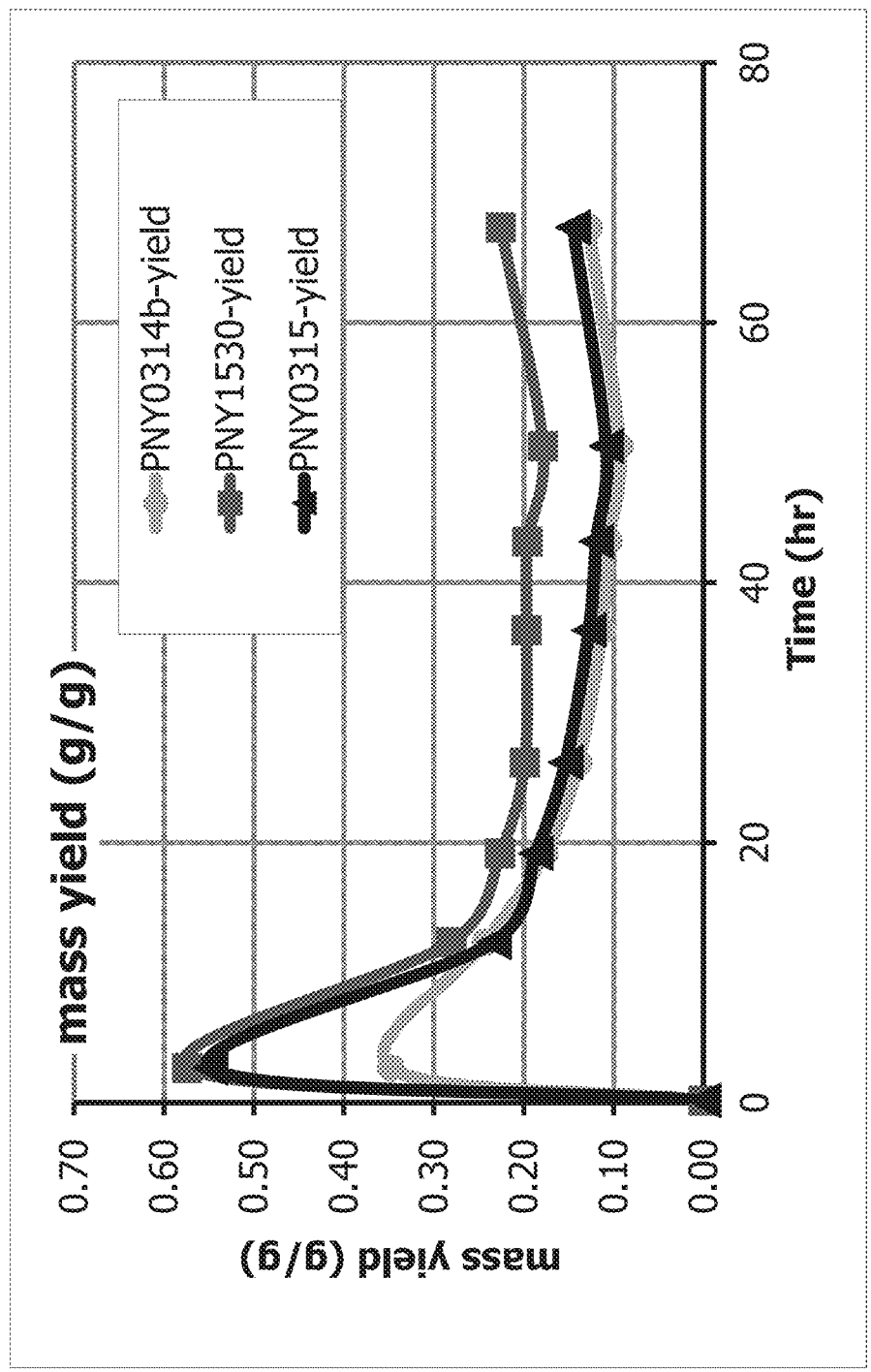
FIG. 5 depicts a graph of isobutanol yields of evolved isobutanol tolerant strains compared to their non-evolved parental strain.
Figure 6:
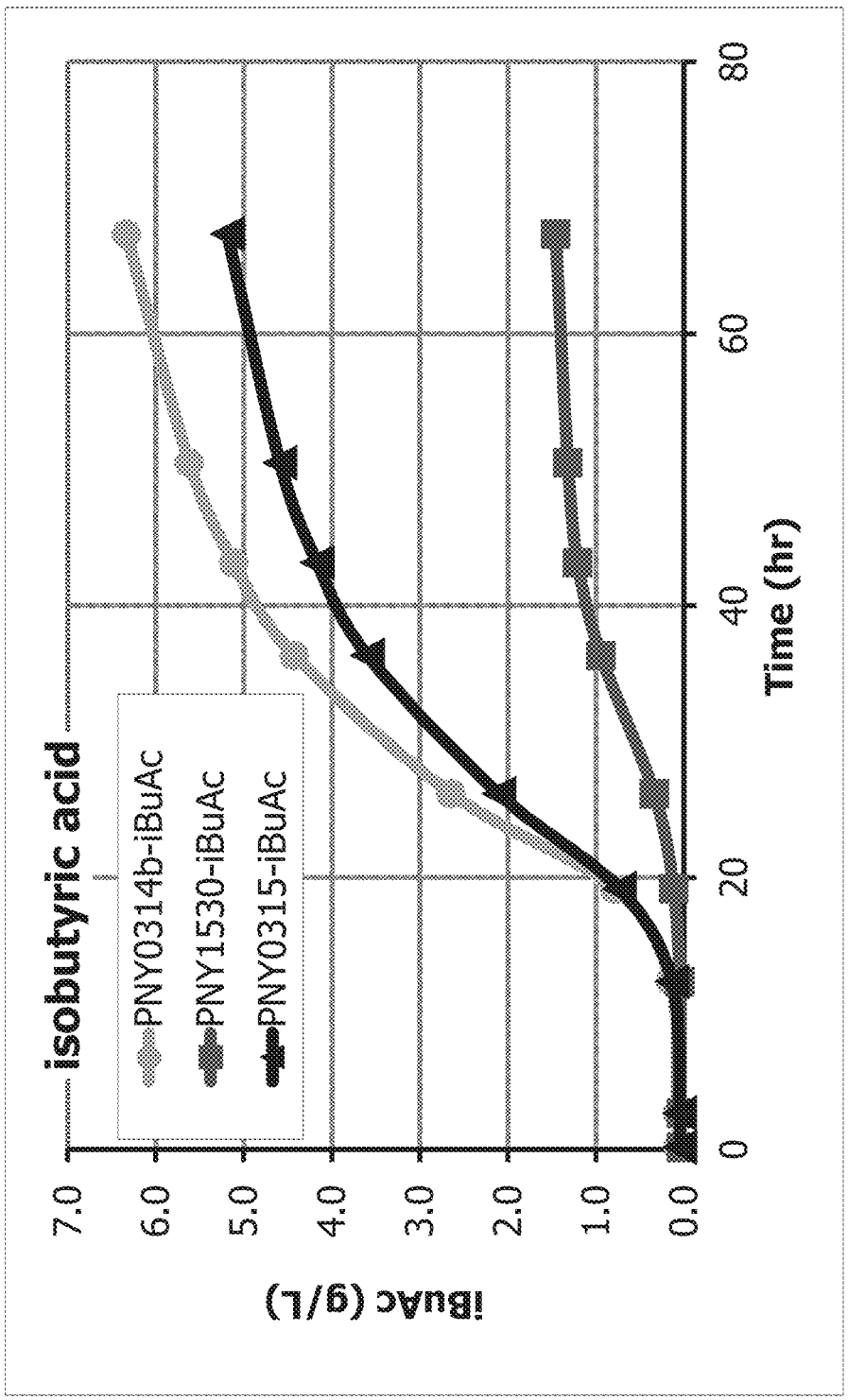
FIG. 6 depicts a graph of isobutryic acid production in evolved isobutanol tolerant strains compared to their non-evolved parental strain.
Figure 7:
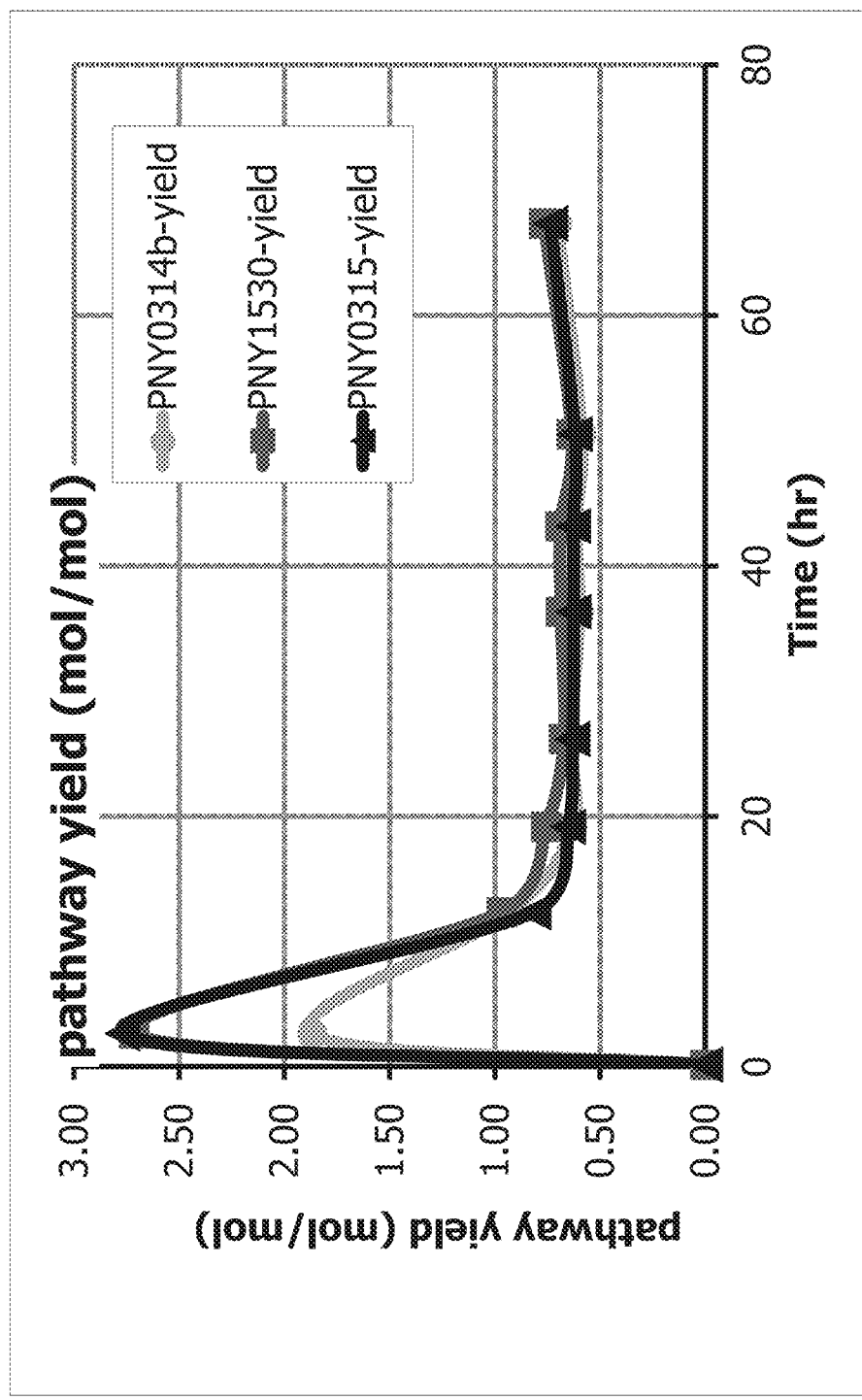
FIG. 7 depicts a graph of engineered isobutanol biosynthetic pathway yields of evolved isobutanol tolerant strains compared to their non-evolved parental strain.

The growth characteristics of PNY1530, PNY0314 and PNY0315 were examined in a batch fermentation process with synthetic medium containing glucose. PNY0314 and PNY0315 grew at higher rates during the logarithmic growth phase and produced more biomass by the onset of stationary phase than PNY1530 (FIG. 2). Although PNY3014 and PNY0315 consumed more glucose than PNY1530 throughout the experiment (FIG. 3), the two variants produced less isobutanol than the control strain (FIG. 4). As a result, PNY0314 and PNY0315 had lower mass yields for isobutanol than PNY1530 (FIG. 5). However, PNY0314 and PNY0315 produced more isobutyric acid than PNY1530 (FIG. 6). The increased levels of isobutyric acid accounted for the lower isobutanol titers (FIG. 4) and yields (FIG. 5) displayed by PNY0314 and PNY0315. However, the pathway yields for all three strains were essentially the same (FIG. 7), indicating that the same amounts of glucose-derived carbon entered the isobutanol pathway in all three strains.

Taken together, the results of the fermentation experiment indicated that PNY0314 and PNY0315 directed more carbon to biomass production than PNY1530 but did so without diverting carbon from the isobutanol pathway.

Example 6

Identification of Mutations

A Puregene Yeast/Bact. Kit (Catalog #158567, Qiagen, Valencia, Calif.) was used to extract genomic DNA from cells grown in 100 ml of SEGU culture medium with shaking at 30° C. for 20 hours. The genomic DNA was used for sequencing using an Illumina HiSeq2000 sequencer (Illumina, San Diego, Calif.) according to standard procedures.

The PNY1530, PNY0314 and the PNY0315 genomic sequences were each assembled by alignment with the CEN.PK113-7D genomic sequence as the reference (BMC Genomics (2010) 11:723). Differences between the reference sequence and each isobutanologen sequence were compiled into spreadsheet lists that were sorted according to chromosome number and base pair position relative to the reference strain. The three lists were then aligned, and mutations were identified that were present in the evolved strains but absent from PNY1530.

The analysis considered ORFs that had been altered by base pair changes in both PNY0314 and PNY0315 (Table 10). Although five of the seven identified ORFs have at least one base pair change at the same position (NUM1, PAU10, YGR109W-B, HSP32 and ATG13), four ORFs have one or more mutations that do not match (FLO9, PAU10, CYR1 and HSP32). Base pair changes represented by higher levels of coverage (i.e., higher sums of the nA;nC;nG;nT numbers in Table 9) can be viewed with higher degrees of confidence. In any event, this observation may indicate that either the non-matching mutations represent problems with sequencing, or certain genes accumulated independent mutations after the PNY0314 and PNY0315 lines diverged. It is most likely that mutations which are identical in both strains (e.g., the T to C change at position 758822 on chromosome 4 in NUM1) occurred before PNY0314 and PNY0315 diverged, and the non-matching mutations (e.g., the mutations in FLO9 on chromosome 1 at position 26035 in PNY0315 and at position 26172 in PNY0314) occurred after the two strains diverged.

FLO9 and CYR1 are the two ORFs that have only independent mutations in both PNY0314 and PNY0315. No matching mutations are present in these ORFs. The presence of independent mutations in CYR1 and FLO9 in both PNY0314 and PNY0315 suggests that these genes may be particularly important to the evolved phenotypes of PNY0314 and PNY0315.

FLO9 encodes a lectin-like protein that is involved in flocculation (*Journal of Applied Microbiology* (2011) 110:1-18). Null mutations in FLO9 result in reduced filamentous and invasive growth (*Genetics* (1996) 144:967-978). Exposure to fusel alcohols such as isobutanol results in invasive and filamentous growth (*Folia Microbiologica* (2008) 53:3-14). Since invasive/filamentous growth may be an adaptation to solid media, mutations in FLO9 may enable cells to grow better in suspension in liquid media.

Figure 8:
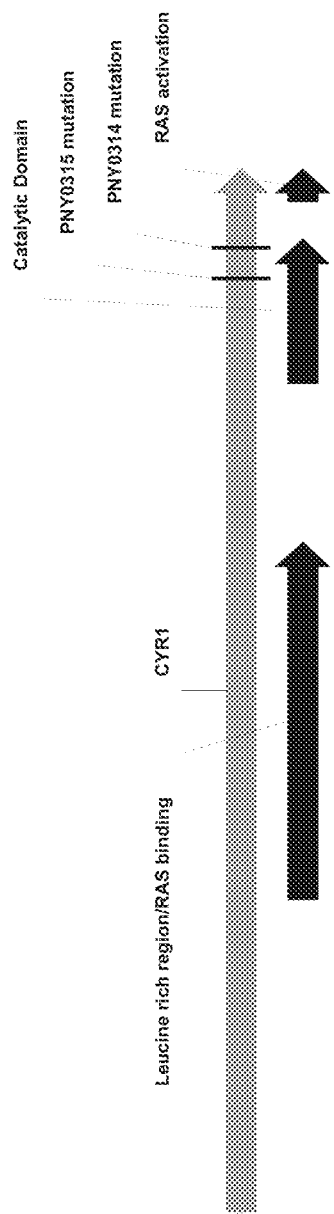
FIG. 8 depicts the CYR1 gene, its domains, and the location of the A1814V and H1873N mutations.

CYR1 encodes adenylate cyclase (PNAS (1985) 82:5060-5063). Adenylate cyclase synthesizes cAMP and is involved in nutrient signaling, cell cycle progression, sporulation, cell growth, stress response, and longevity through activation of the cAMP-dependent protein kinase (*Microbiology and Molecular Biology Reviews* (2006) 70:253-282; *Microbiology and Molecular Biology Reviews* (2003) 67:376-399). The PNY0314 CYR1 mutation at position 430767 and the PNY0315 CYR1 mutation at position 430591 are both located within the catalytic domain of Cyr1p (FIG. 8; *Proc. Natl. Acad. Sci. U.S.A.* (1990) 87:8711-8715). Both mutations have been confirmed by re-sequencing the 3' portion of CYR1 from PNY1530, PNY0314 and PNY0315. CYR1 is an essential gene, and null mutations in CYR1 block cell division in the G1 phase; however, other mutations in CYR1 can lead to increased stress resistance (*Proc. Natl. Acad. Sci. U.S.A.* (1982) 79:2355-2359; *Experimental Gerontology* (2003) 38:807-811). Hence, the CRY1 mutations in PNY0314 and PNY0315 are most likely change of function mutations that alter the levels of cAMP in these variants.

TABLE 10

Mutations detected by sequencing of PNY0314 and PNY0315

| Strain | Mutation | Chromosome | Ref | nA; nC; nG; nT | Call | Gene | Function |
|---|---|---|---|---|---|---|---|
| PNY0315 | 26035 | 1 | G | 3; 0; 1; 0 | A | FLO9 | Lectin-like protein with similarity to Flo1p |
| PNY0314 | 26172 | 1 | T | 0; 15; 0; 4 | C | | |
| PNY0314 | 27110 | 1 | A | 1; 0; 4; 0 | G | | |
| PNY0314 | 758822 | 4 | C | 0; 7; 0; 24 | T | NUM1 | Protein required for nuclear migration |
| PNY0315 | 758822 | 4 | C | 0; 17; 0; 55 | T | | |
| PNY0314 | 1523311 | 4 | A | 0; 0; 5; 0 | G | PAU10 | Protein of unknown function |
| PNY0315 | 1523311 | 4 | A | 3; 0; 20; 0 | G | | |
| PNY0314 | 1523329 | 4 | C | 0; 1; 0; 4 | T | | |
| PNY0314 | 1523341 | 4 | G | 5; 0; 1; 0 | A | | |
| PNY0315 | 1523341 | 4 | G | 18; 0; 4; 0 | A | | |
| PNY0315 | 1523401 | 4 | C | 0; 2; 0; 9 | T | | |
| PNY0314 | 711742 | 7 | C | 0; 4; 0; 18 | T | YGR109W-B | Retrotransposon TYA Gag and TYB Pol genes |
| PNY0315 | 711742 | 7 | C | 0; 16; 0; 51 | T | | |
| PNY0315 | 430591 | 10 | C | 0; 0; 0; 69 | T | CYR1 | Adenylate cyclase, required for cAMP production and cAMP-dependent protein kinase signaling |
| PNY0314 | 430767 | 10 | C | 29; 0; 0; 0 | A | | |
| PNY0314 | 12429 | 16 | C | 0; 2; 0; 8 | T | HSP32 | Heat-Shock Protein |
| PNY0315 | 12429 | 16 | C | 0; 2; 0; 8 | T | | |
| PNY0315 | 12519 | | A | 1; 5; 0; 0 | C | | |
| PNY0314 | 908163 | 16 | C | 3; 0; 0; 0 | A | ATG13 | Regulatory subunit of the Atg1p signaling complex |
| PNY0315 | 908163 | 16 | C | 5; 0; 0; 0 | A | | |

("Ref" is the nucleotide in the reference genome; "Call" is the nucleotide seen in the most sequencing reads at a specific position.)

Example 7

Construction of PNY1556, PNY1556 CYR1 Variants PNY1567-PNY1572, and Isobutanologens PNY1579-PNY1599

Construction of PNY1556

Described here is the assembly of the constructs used to replace the chromosomal copy of kivD_Ll(y) (SEQ ID NO: 123) in PNY1528 at the adh1Δ locus with kivD_Lg(y) (SEQ ID NO: 122) and construction of strain PNY1556 expressing the kivD_Lg(y) gene. Deletions/integrations were created by homologous recombination with PCR products containing regions of homology upstream and downstream of the target region and the URA3 gene for selection of transformants as described in the prior section. The plasmid to integrate kivD_Lg(y) was derived from a plasmid constructed to integrate UAS(PGK1)P[FBA1]-kivD_Ll(y) into the ADH1 locus of Saccharomyces cerevisiae. Construction of the plasmid used to integrate UAS(PGK1)P[FBA1]-kivD_Ll(y) into the ADH1 locus is described below. The plasmids were constructed in pUC19-URA3MCS.

The kivD coding region from Lactococcus lactis codon-optimized for expression in Saccharomyces cerevisiae, kivD_Ll(y), was amplified using pLH468 (SEQ ID NO: 124) as template with primer oBP562 (SEQ ID NO: 103), containing a PmeI restriction site, and primer oBP563 (SEQ ID NO: 104), containing a 5' tail with homology to the 5' end of ADH1 Fragment B. ADH1 Fragment B was amplified from Saccharomyces cerevisiae CEN.PK 113-7D genomic DNA with primer oBP564 (SEQ ID NO: 105), containing a 5' tail with homology to the 3' end of kivD_Ll(y), and primer oBP565 (SEQ ID NO: 106), containing a FseI restriction site. PCR products were purified with a PCR Purification kit (Qiagen; Valencia, Calif.). kivD_Ll(y)-ADH1 Fragment B was created by overlapping PCR by mixing the kivD_Ll(y) and ADH1 Fragment B PCR products and amplifying with primers oBP562 (SEQ ID NO: 103) and oBP565 (SEQ ID NO 106). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 107), containing a SacI restriction site, and primer oBP506 (SEQ ID NO: 108), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO: 109), containing a PacI restriction site, and primer oBP508 (SEQ ID NO: 110), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-PFBA1 (SEQ ID NO: 125) was amplified from vector pRS316-UAS(PGK1)-PFBA1-GUS with primer oBP674 (SEQ ID NO: 111), containing an AscI restriction site, and primer oBP675 (SEQ ID NO: 112), containing a PmeI restriction site. The UAS(PGK1)-PFBA1 PCR product was digested with AscI and PmeI and ligated with T4 DNA ligase into the corresponding sites of the plasmid containing kivD_Ll(y)-ADH1 Fragments ABC to generate pBP1181.

kivD_Ll(y) was removed from the ADH1 deletion/UAS(PGK1)P[FBA1]-kivD_Ll(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 113), containing a PmeI restriction site, and primer oBP484 (SEQ ID NO: 114), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_Ll(y) was cloned into the resulting vector for the targeted deletion of kivD_Ll(y) in PNY1528. The fragment was amplified from pBP1181 with primers oBP822 (SEQ ID NO: 115), containing a NotI restriction site, and oBP823 (SEQ ID NO: 116), containing a PacI restriction site. The fragment was digested with NotI and PacI and ligated with T4 DNA ligase into the corresponding sites downstream of URA3 in the above plasmid with the kivD_Ll(y) deletion after digestion with the appropriate restriction enzymes. The resulting plasmid was designated pBP1716.

The kivD coding region from *Listeria grayi* codon-optimized for expression in *Saccharomyces cerevisiae* (SEQ ID NO: 122), kivD_Lg(y), was synthesized by DNA2.0 (Menlo Park, Calif.). kivD_Lg(y) was amplified with primers oBP828 (SEQ ID NO: 117), containing a PmeI restriction site, and oBP829 (SEQ ID NO: 118) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 126) and oBP829 (SEQ ID NO: 118). An isolate with kivD_Lg(y) in the correct orientation was designated pBP1719.

The kivD_Ll(y) deletion/kivD_Lg(y) integration cassette was amplified from pBP1719 with primers oBP505 (SEQ ID NO: 107) and oBP823 (SEQ ID NO: 116). Competent cells of PNY1528 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30° C. Transformants were grown in YPE (1% ethanol) and plated on synthetic complete medium supplemented with 1% ethanol and containing 5-fluoro-orotic acid (0.1%) at 30° C. to select for isolates that lost the URA3 marker. The deletion of kivD_Ll(y) and integration of kivD_Lg(y) was confirmed by PCR with primers oBP674 (SEQ ID NO: 111) and oBP830 (SEQ ID NO: 127) using genomic DNA prepared with a YeaStar Genomic DNA kit (Zymo Research). A correct isolate contained kivD_Lg(y) at the same locus and expressed from the same promoter as kivD_Ll(y) in PNY1528 and was designated PNY1556.

Construction of PNY1556 CYR1 Variants PNY1567-PNY1572, and Isobutanologens PNY1579-PNY1599

The amino acid mutations identified in the CYR1 gene in Example 6, along with a wild-type control, were created in strain PNY1556. The mutations and control were introduced into PNY1556 by homologous recombination, as described in the scarless deletion/integration procedure above, without leaving a marker or scar. To aid in the gene replacement, the 3' 642 bp (nucleotides 5440-6081) of the CEN.PK 113-7D CYR1 gene was codon-optimized (SEQ ID NO: 128) and synthesized (IDT, Coralville, Iowa). The mutations, A1814V and H1873N, were individually introduced into the codon-optimized sequence by PCR with primers containing the appropriate base changes; codon 1814 (nucleotides 5440-5442) changed from GCC to GTT and codon 1873 (nucleotides 5617-5619) changed from CAC to AAC.

An integration vector for the CYR1 wild-type 3' 642 bp codon-optimized sequence was cloned into pUC19-URA3MCS. First, the native CEN.PK 113-7D CYR1 3' 642 bp, nucleotides 5440-6081 of SEQ ID NO: 129 (CEN.PK 113-7D wild-type CYR1 with native nucleotides from 5440-6081), was used as the downstream homology region (fragment C) for integration of the cassette. This sequence was amplified with an upstream primer containing a NotI restriction site and a downstream primer containing a PacI restriction site and cloned into the corresponding sites in pUC19-URA3MCS downstream of URA3. 1000 bp upstream of the CYR1 3' 642 bp region, nucleotides 4440-5439 of SEQ ID NO: 129 (CEN.PK 113-7D wild-type CYR1 with native nucleotides from 5440-6081), was used as the upstream homology region (fragment A) for integration of the cassette. The 1000 bp region, along with the wild-type 3' 642 bp codon-optimized sequence, and the 500 bp sequence from CEN.PK 113-7D immediately downstream of the CYR1 gene (fragment B) (SEQ ID NO: 130) were all combined by overlapping PCR. The resulting 3-part PCR product amplified with an upstream primer containing a PmeI restriction site and a downstream primer containing a FseI restriction site was cloned into the corresponding sites upstream of URA3 in the pUC19-URA3MCS-fragmentC vector from above to create the wild-type CYR1 codon-optimized integration vector. The resulting plasmid, specifically fragment A—3' 642 bp codon-optimized region—fragment B, was used as a template to create the two variant integration vector versions by using primers containing the appropriate base changes (described above) and overlapping PCR. The resulting PCR products of fragment A—3' 642 bp codon-optimized region—fragment B containing the A1814V or H1873N mutations were cloned into the appropriate sites upstream of URA3 in the pUC19-URA3MCS-fragmentC vector, resulting in the two variant integration vectors; A1814V codon-optimized and H1873N codon-optimized.

The integration cassettes from each integration vector were amplified and used to transform PNY1556 using a Frozen-EZ Yeast Transformation II kit (Zymo Research; Orange, Calif.). Transformation mixtures were plated on synthetic complete media lacking uracil supplemented with 1% ethanol at 30° C. Transformants were checked by PCR for integration at the correct locus. Two independent transformants for each cassette were grown in YPE (1% ethanol) and plated on synthetic complete medium supplemented with 1% ethanol and containing 5-fluoro-orotic acid (0.1%) at 30° C. to select for isolates that lost the URA3 marker. The replacement of the native 3' 642 bp CYR1 sequence with the wild-type or variant codon-optimized sequences was confirmed by PCR and sequencing. Three types of strains (two independent isolates of each) were created with changes in the CYR1 nucleotide sequence. PNY1567 and PNY1568: independent isolates of CYR1 wild-type amino acid sequence with the 3' 642 bp codon-optimized (cyr1::CYR1(3' y)). PNY1569 and PNY1570: independent isolates of CYR1H1873N with the 3' 642 bp codon-optimized (cyr1::cyr1 H1873N(3' y)). PNY1571 and PNY1572: independent isolates of CYR1A1814V with the 3' 642 bp codon-optimized (cyr1::cyr1 A1814V(3' y)).

All six strains were transformed with plasmid pYZ107F-OLE1p (SEQ ID NO: 214) using a Frozen-EZ Yeast Transformation II kit (Zymo Research; Orange, Calif.). Three transformants for each independent strain were selected. PNY1582, PNY1583, and PNY1584 were transformants of PNY1567. PNY1585, PNY1586, and PNY1587 were transformants of PNY1568. PNY1588, PNY1589, and PNY1590 were transformants of PNY1569. PNY1591, PNY1592, and PNY1593 were transformants of PNY1570. PNY1594, PNY1595, and PNY1596 were transformants of PNY1571. PNY1597, PNY1598, and PNY1599 were transformants of PNY1572. As a control for the codon-optimization of the 3' 642 bp of CYR1, PNY1556 was transformed with pYZ107F-OLE1p to create PNY1579, PNY1580, and PNY1581.

Example 8

Aerobic, Glucose Excess Shake Flask Growth Experiment

This example describes a shake flask growth experiment with strains PNY1579, PNY1583, PNY1587, PNY1589, PNY1593, PNY1594, and PNY1597 demonstrating the higher levels of biomass achieved with the strains containing the A1814V or H1873N CYR1 mutations in aerobic, glucose excess conditions.

PNY1579, PNY1583, PNY1587, PNY1589, PNY1593, PNY1594, and PNY1597 were grown overnight in low glucose medium. The low glucose medium consisted of: 6.7 g/L Difco Yeast Nitrogen Base w/o amino acids (Becton Dickinson; Sparks, Md.), 1.92 g/L Synthetic Drop-out Medium Supplement w/out Uracil (Sigma; St. Louis, Mo.), 0.1% w/v ethanol, 0.3% w/v glucose, 100 mM 2-Morpholinoethanesulphonic acid (MES) buffer, adjusted to pH 5.5 with KOH. 12 ml of low glucose medium in a 125 ml VWR vent cap shake flask was inoculated with cells grown on an agar plate containing the same medium. Cultures were grown overnight at 30° C. at 250 RPM in a New Brunswick I24 incubated shaker. Overnight cultures were centrifuged at 3800×g for 5 minutes at room temperature. Cell pellets were resuspended in 1 ml of high glucose medium. High glucose medium consisted of: 6.7 g/L Difco Yeast Nitrogen Base w/o amino acids (Becton Dickinson; Sparks, Md.), 1.92 g/L Synthetic Drop-out Medium Supplement w/out Uracil (Sigma; St. Louis, Mo.), 0.1% w/v ethanol, 3.0% w/v glucose, 100 mM 2-Morpholinoethanesulphonic acid (MES) buffer, adjusted to pH 5.5 with KOH. 12 ml of high glucose medium in a 125 ml VWR vent cap shake flask was inoculated with resuspended cells to a final $OD_{600}$ of 0.1. Duplicate flasks were inoculated for each strain. Cultures were grown at 30° C. at 250 RPM in a New Brunswick 124 incubated shaker and the OD600 was monitored for 29 hours.

Figure 9:
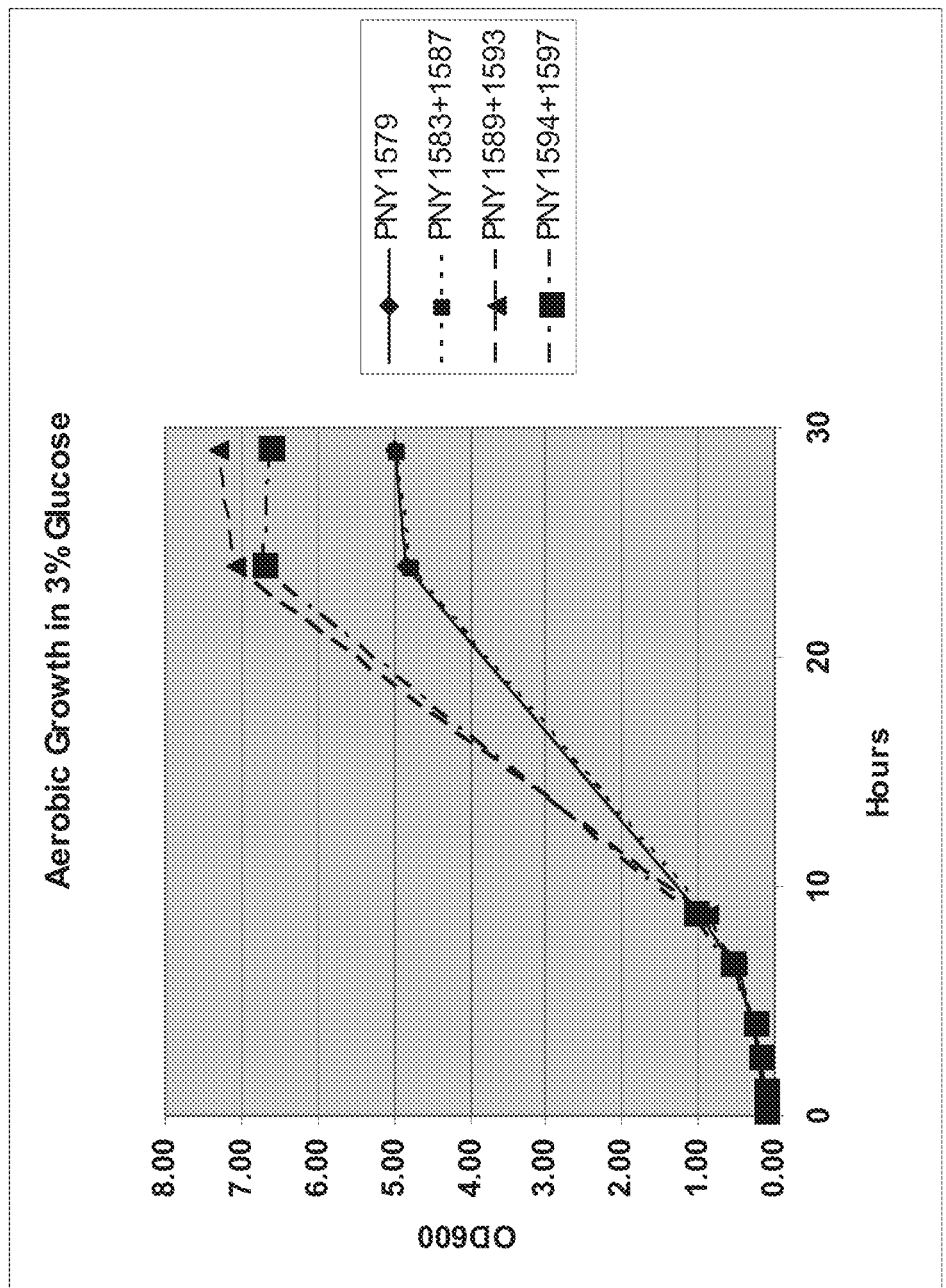
FIG. 9 depicts growth curves of yeast comprising reduced pyruvate decarboxylase activity and expressing either wild-type, A1814V, or H1873N CYR1.

FIG. 9 shows the OD measurements for the growth experiment. The reported OD measurements are the averages of the technical and biological replicates. The growth of the wild-type codon-optimized CYR1 strains, PNY1583 and PNY1587, matched the growth of the wild-type native CYR1 strain, PNY1579, indicating that the codon-optimization of the 3' 642 bp of CYR1 did not impact growth of the cell. Both CYR1 mutations resulted in a higher final biomass compared to the wild-type codon-optimized CYR1 strains, PNY1583 and PNY1587. At 29 hours, the CYR1H1873N strains PNY1589 and PNY1593 had an $OD_{600}$ of 7.3 and the CYR1A1814V strains PNY1594 and PNY1597 had an $OD_{600}$ of 6.6, 48% and 34% higher, respectively, than the wild-type codon-optimized CYR1 strains PNY1583 and PNY1587 at an $OD_{600}$ of 4.9.

While various embodiments of the present invention have been described above, it should be understood that they have been presented by way of example only, and not limitation. It will be apparent to persons skilled in the relevant art that various changes in form and detail can be made therein without departing from the spirit and scope of the invention. Thus, the breadth and scope of the present invention should not be limited by any of the above-described exemplary embodiments, but should be defined only in accordance with the following claims and their equivalents.

All publications, patents and patent applications mentioned in this specification are indicative of the level of skill of those skilled in the art to which this invention pertains, and are herein incorporated by reference to the same extent as if each individual publication, patent or patent application was specifically and individually indicated to be incorporated by reference.

SEQUENCE LISTING (242 sequences)

SEQ ID NO: 1 - protein, 2026 aa, Saccharomyces cerevisiae
MSSKPDTGSEISGPQRQEEQEQQIEQSSPTEANDRSIHDEVPKVKKRHEQNSGHKSRRNSAYSYYSPRSLSMTKSRESITPNGMDDVSISNVEHPRPTEPKIKRGPYLLKKTLSSLSMTSANSTHDDNKDHGYALNSSKTHNYTSTHNHHDGHHDHHHVQFFPNRKPSLAETLFKRFSGSNSHDGNKSGKESKVANLSLSTVNPAPANRKPSKDSTLSNHLADNVPSTLRRKVSSLVRGSSVHDINNGIADKQIRPKAVAQSENTLHSSDVPNSKRSHRKSFLLGSTSSSSSRRGSNVSSMTNSDSASMATSGSHVLQHNVSNVSPTTKSKDSVNSESADHTNNKSEKVTPEYNENIPENSNSDNKREATTPTIETPISCKPSLFRLDTNLEDVTDITKTVPPTAVNSTLNSTHGTETASPKTVIMPEGPRKSVSMADLSVAAAAPNGEFTSTSNDRSQWVAPQSWDVETKRKKTKPKGRSKSRRSSIDADELDPMSPGPPSKKDSRHHHDRKDNESMVTAGDSNSSFVDICKENVPNDSKTALDTKSVNRLKSNLAMSPPSIRYAPSNLDGDYDTSSTSSSLPSSSISSEDTSSCSDSSSYTNAYMEANREQDNKTPILNKTKSYTKKFTSSSVNMNSPDGAQSSGLLLQDEKDDEVECQLEHYYKDFSDLDPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITKAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTDLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDETDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIAMSSDFYSEFNKIMKYHERVVKGKESLKEVYGEEIIGEVLEREIAMLESIGWAFFDFGEHKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 2 - protein, 2026 aa, Saccharomyces cerevisiae
MSSKPDTGSEISGPQRQEEQEQQIEQSSPTEANDRSIHDEVPKVKKRHEQNSGHKSRRNSAYSYYSPRSLSMTKSRESITPNGMDDVSISNVEHPRPTEPKIKRGPYLLKKTLSSLSMTSANSTHDDNKDHGYALNSSKTHNYTSTHNHHDGHHDHHHVQFFPNRKPSLAETLFKRFSGSNSHDGNKSGKESKVANLSLSTVNPAPANRKPSKDSTLSNHLADNVPSTLRRKVSSLVRGSSVHDINNGIADKQIRPKAVAQSENTLHSSDVPNSKRSHRKSFLLGSTSSSSSRRGSNVSSMTNSDSASMATSGSHVLQHNVSNVSPTTKSKDSVNSESADHTNNKSEKVTPEYNENIPENSNSDNKREATTPTIETPISCKPSLFRLDTNLEDVTDITKTVPPTAVNSTLNSTHGTETASPKTVIMPEGPRKSVSMADLSVAAAAPNGEFTSTSNDRSQWVAPQSWDVETKRKKTKPKGRSKSRRSSIDADELDPMSPGPPSKKDSRHHHDRKDNESMVTAGDSNSSFVDICKENVPNDSKTALDTKSVNRLKSNLAMSPPSIRYAPSNLDGDYDTSSTSSSLPSSSISSEDTSSCSDSSSYTNAYMEANREQDNKTPILNKTKSYTKKFTSSSVNMNSPDGAQSSGLLLQDEKDDEVECQLEHYYKDFSDLDPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITKAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTDLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDETDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIVMSSDFYSEFNKIMKYHERVVKGKESLKEVYGEEIIGEVLEREIAMLESIGWAFFDFGEHKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 3 - protein, 2026 aa, Saccharomyces cerevisiae
MSSKPDTGSEISGPQRQEEQEQQIEQSSPTEANDRSIHDEVPKVKKRHEQNSGHKSRRNSAYSYYSPRSLSMTKSRESITPNGMDDVSISNVEHPRPTEPKIKRGPYLLKKTLSSLSMTSANSTHDDNKDHGYALNSSKTHNYTSTHNHHDGHHDHHHVQFFPNRKPSLAETLFKRFSGSNSHDGNKSGKESKVANLSLSTVNPAPANRKPSKDSTLSNHLADNVPSTLRRKVSSLVRGSSVHDINNGIADKQIRPKAVAQSENTLHSSDVPNSKRSHRKSFLLGSTSSSSSRRGSNVSSMTNSDSASMATSGSHVLQHNVSNVSPTTKSKDSVNSESADHTNNKSEKVTPEYNENIPENSNSDNKREATTPTIETPISCKPSLFRLDTNLEDVTDITKTVPPTAVNSTLNSTHGTETASPKTVIMPEGPRKSVSMADLSVAAAAPNGEFTSTSNDRSQWVAPQSWDVETKRKKTKPKGRSKSRRSSIDADELDPMSPGPPSKKDSRHHHDRKDNESMVTAGDSNSSFVDICKENVPNDSKTALDTKSVNRLKSNLAMSPPSIRYAPSNLDGDYDTSSTSSSLPSSSISSEDTSSCSDSSSYTNAYMEANREQDNKTPILNKTKSYTKKFTSSSVNMNSPDGAQSSGLLLQDEKDDEVECQLEHYYKDFSDLDPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITKAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTDLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDETDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIAMSSDFYSEFNKIMKYHERVVKGKESLKEVYGEEIIGEVLEREIAMLESIGWAFFDFGENKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 4 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 5 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 6 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 7 - DNA, 1680 bp, Klebsiella pneumoniae
atggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 8 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 9 - DNA, 1665 bp, Lactococcus lactis
atgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattga

SEQ ID NO: 10 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 11 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 12 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 13 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 14 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 15 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 16 - DNA, 1476 bp, Bacillus subtilis; identical to SEQ ID NO: 13

SEQ ID NO: 17 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 18 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 19 - protein, 550 aa, Methanococcus maripaludis
MISDNVKKGVIRTPNRALLKACGYTDEDMEKPFIGIVNSFTEVVPGHIHLRTLSEAAKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKYELISLFEGVGEYQVGKITEEELKCIEDCACSGAGSCAGLYTANSMACLTEALGLSLPMCATTHAVDAQKVRLAKKSGSKIVDMVKEDLKPTDILTKEAFENAILVDLALGGSTNTTLHIPAIANEIENKFITLDDFDRLSDEVPHIASIKPGGEHYMIDLHNAGGIPAVLNVLKEKIRDTKTVDGRSILEIAESVKYINYDVIRKVEAPVHETAGLRVLKGNLAPNGCVVKIGAVHPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIEKEINVDLDESVIKERLSKLGEFEPKIKKGYLSRYSKLVSSADEGAVLK

SEQ ID NO: 20 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 21 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 22 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 23 - DNA, 1653 bp, Methanococcus maripaludis
atgataagtgataacgtcaaaaagggagttataagaactccaaaccgagctcttttaaaggcttgcggatatacagacgaagacatggaaaaaccatttattggaattgtaaacagctttacagaagttgttcccggccacattcacttaagaacattatcagaagcggctaaacatggtgtttatgcaaacggtggaacaccatttgaatttaataccattggaatttgcgacggtattgcaatgggccacgaaggtatgaaatactctttaccttcaagagaaattattgcagacgctgttgaatcaatggcaagagcacatggatttgatggtcttgttttaattcctacgtgtgataaaatcgttcctggaatgataatgggtgctttaagactaaacattccatttattgtagttactggaggaccaatgcttcccggagaattccaaggtaaaaaatacgaacttatcagcctttttgaaggtgtcggagaataccaagttggaaaaattactgaagaagagttaaagtgcattgaagactgtgcatgttcaggtgctggaagttgtgcagggctttacactgcaaacagtatggcctgccttacagaagctttgggactctctcttccaatgtgtgcaacaacgcatgcagttgatgcccaaaaagttaggcttgctaaaaaaagtggctcaaaaattgttgatatggtaaaagaagacctaaaaccaacagacatattaacaaaagaagcttttgaaaatgctattttagttgaccttgcacttggtggatcaacaaacacaacattacacattcctgcaattgcaaatgaaattgaaaataaattcataactctcgatgactttgacaggttaagcgatgaagttccacacattgcatcaatcaaaccaggtggagaacactacatgattgatttacacaatgctggaggtattcctgcggtattgaacgttttaaaagaaaaaattagagatacaaaaacagttgatggaagaagcattttggaaatcgcagaatctgttaaatacataaattacgacgttataagaaaagtggaagctccggttcacgaaactgctggtttaagggttttaaagggaaatcttgctccaaacggttgcgttgtaaaaatcggtgcagtacatccgaaaatgtacaaacacgatggacctgcaaaagtttacaattccgaagatgaagcaatttctgcgatacttggcggaaaaattgtagaaggggacgttatagtaatcagatacgaaggaccatcaggaggccctggaatgagagaaatgctctccccaacttcagcaatctgtggaatgggtcttgatgacagcgttgcattgattactgatggaagattcagtggtggaagtaggggcccatgtatcggacacgtttctccagaagctgcagctggcggagtaattgctgcaattgaaaacggggatatcatcaaaatcgacatgattgaaaaagaaataaatgttgatttagatgaatcagtcattaaagaaagactctcaaaactgggagaatttgagcctaaaatcaaaaaaggctatttatcaagatactcaaaacttgtctcatctgctgacgaaggggcagttttaaaataa

SEQ ID NO: 24 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 25 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 26 - protein, 330 aa, Methanococcus maripaludis; identical to SEQ ID NO: 11

SEQ ID NO: 27 - DNA, 1662 bp, Lactococcus lactis
tctagacatatgtatactgtgggggattacctgctggatcgcctgcacgaactggggattgaagaaattttcggtgtgccaggcgattataacctgcagttcctggaccagattatctcgcacaaagatatgaagtgggtcggtaacgccaacgaactgaacgcgagctatatggcagatggttatgcccgtaccaaaaaagctgctgcgtttctgacgacctttggcgttggcgaactgagcgccgtcaacggactggcaggaagctacgccgagaacctgccagttgtcgaaattgttgggtcgcctacttctaaggttcagaatgaaggcaaatttgtgcaccatactctggctgatggggattttaaacattttatgaaaatgcatgaaccggttactgcggcccgcacgctgctgacagcagagaatgctacggttgagatcgaccgcgtcctgtctgcgctgctgaaagagcgcaagccggtatatatcaatctgcctgtcgatgttgccgcagcgaaagccgaaaagccgtcgctgccactgaaaaaagaaaacagcacctccaatacatcggaccaggaaattctgaataaaatccaggaatcactgaagaatgcgaagaaaccgatcgtcatcaccggacatgagatcatctcttttggcctggaaaaaacggtcacgcagttcatttctaagaccaaactgcctatcaccaccctgaacttcggcaaatctagcgtcgatgaagcgctgccgagttttctgggtatctataatggtaccctgtccgaaccgaacctgaaagaattcgtcgaaagcgcggactttatcctgatgctgggcgtgaaactgacggatagctccacaggcgcatttacccaccatctgaacgagaataaaatgatttccctgaatatcgacgaaggcaaaatctttaacgagcgcatccagaacttcgattttgaatctctgattagttcgctgctggatctgtccgaaattgagtataaaggtaaatatattgataaaaaacaggaggattttgtgccgtctaatgcgctgctgagtcaggatcgtctgtggcaagccgtagaaaacctgacacagtctaatgaaacgattgttgcggaacagggaacttcatttttcggcgcctcatccatttttctgaaatccaaaagccatttcattggccaaccgctgtgggggagtattggttatacctttccggcggcgctgggttcacagattgcagataaggaatcacgccatctgctgtttattggtgacggcagcctgcagctgactgtccaggaactggggctggcgatccgtgaaaaaatcaatccgatttgctttatcatcaataacgacggctacaccgtcgaacgcgaaattcatggaccgaatcaaagttacaatgacatcccgatgtggaactatagcaaactgccggaatcctttggcgcgacagaggatcgcgtggtgagtaaaattgtgcgtacggaaaacgaatttgtgtcggttatgaaagaagcgcaggctgacccgaatcgcatgtattggattgaactgatcctggcaaaagaaggcgcaccgaaagttctgaaaaagatggggaaactgtttgcggagcaaaataaaagctaaggatcc

SEQ ID NO: 28 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 29 - DNA, 1644 bp, Lactococcus lactis
atgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatag

SEQ ID NO: 30 - DNA, 3969 bp, Saccharomyces cerivisiae
atgtctctggcacattattgtttactactagccatcgtcacattgctgggattaactaatgttgtctctgcgactacagcggcatgcctgccagcaaactcaaggaagaatggtatgaatgtaaacttttaccagtattcattgagagattcctccacatattcgaatgcagcatatatggcttatggatatgcctcaaaaactaaactgggttctgtcggaggacaaactgatatctcgattgattataatattccttgtgttagttcatcaggcacatttccttgtcctcaagaagatttatatggtaattggggatgcaaaggaattggtgcttgttctaataatccaataattgcatactggagtactgatttatttggtttctatactaccccaacaaacgtaaccctagaaatgacaggttattttttaccaccacagacgggttcttacacattcaagtttgctacagttgacgactctgcaattctatcagtcggtggtagcattgcgttcgaatgttgtgcacaagaacaacctcccatcacgtcgactaacttcaccatcaatggtatcaagccatggaatggaagtccccctgataatattacagggactgtctacatgtatgctggtttctattatccaatgaagattgtttactcaaatgccgttgcctggggtacacttccaattagtgtgacactaccagatggcactaccgttagtgatgactttgaagggtacgtatatacttttgacaacaatctaagccagccaaactgtaccattccagacccttcaaattatactgtcagtactaccataactacaacggaaccatggaccggtactttcacttctacatctactgaaatgaccaccgtcaccggtaccaacggcgttccaactgacgaaaccgtcattgtcatcagaactccaacaactgctagcaccatcataactacaactgagccatggaacagcacttttacctctacttctaccgaattgaccacagtcactggcaccaatggtgtacgaactgacgaaaccatcattgtaatcagaacaccaacaacagccactactgccataactacaactgagccatggaacagcacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacatccactgaaatcaccaccgtcaccggtaccaatggtttgccaactgatgagaccatcattgtcatcagaacaccaacaacagccactactgccatgactacaactcagccatggaacgacacttttacctctacatccactgaaatgaccaccgtcaccggtaccaacggtttgccaactgatgaaaccatcattgtcatcagaacaccaacaacagccactactgccataactacaactgagccatggaacagcacttttacctctacatccactgaaatgaccaccgtcaccggtaccaacggtttgccaactgatgaaaccatcattgtcatcagaacaccaacaacagccactactgccataactacaactcagccatggaacgacacttttacctctacatccactgaaatgaccaccgtcaccggtaccaacggtttgccaactgatgaaaccatcattgtcatcagaacaccaacaacagccactactgccatgactacaactcagccatggaacgacacttttacctctacatccactgaaatcaccaccgtcaccggtaccaacggtttgccaactgatgagaccatcattgtcatcagaacaccaacaacagccactactgccatgactacaactcagccatggaacgacacttttacctctacatccactgaaatgaccaccgtcaccggtaccaacggcgttccaactgacgaaaccgtcattgtcatcagaactccaactagtgaaggtctaatcagcaccaccactgaaccatggactggtactttcacctctacatccactgagatgaccaccgtcaccggtactaacggtcaaccaactgacgaaaccgtgattgttatcagaactccaaccagtgaaggtttggttacaactacaaccgagccatggaccggtactttcacctctacatctactgagatgaccaccatcactggaaccaacggtcaaccaactgatgaaactgtcattattgtcaaaactccaactactgccatctcatccagtttgtcatcttcttcaggacaaatcaccagctttatcacgtctgcgcgtccaattattaccccattctatcctagcaatggaacttctgtgatttcctcctcagtaatttcttcctcagacacttcttctctagtcatttcttcctcagtcacttcttctctagtcacttcttctccagtcatttcttcttcattcatttcttcccctgtcatttcttctacaacaacctccgcttctatactctctgaatcatctaaatcatccgtcattccaaccagtagttccacctctggttcttctgagagcgaaacgggttcagctagttctgcctcttcttcctcttctatctcttctgaatcaccaaagtctacatattcgtcttcatcattaccacctgttaccagtgcaacaacaagtcaggaaattacttcttcattaccacctgttaccactacaaaaacgagcgaacaaaccactttggttaccgtgacatcctgcgaatctcatgtgtgcactgaatctatctcctctgcgattgtttccacggccaccgttactgttagcggtgccacaacagagtataccacatggtgccctatttctaccacagagataacaaagcaaactacggagacaacaaagcaaaccaaggggacaacagagcaaaccacagaaacaacaaaacaaaccacagtagttacaatttcttcttgtgaatctgacgtatgctctaagactgcttctccagccattgtatctacaagcactgctactattaatggcgttaccacagaatacacaacatggtgtcctatttccaccacagaatcgaagcaacaaactacgctagttactgttacttcctgcggatctggtgtgtgttccgaaactacttcacctgccattgtttcgacggccacggctactgtgaatgatgttgttacggtctattctacatggaggccacagactacgaatgaacagtctgtcagctctaaaatgaacagtgctaccagtgagacaacaaccaatactggagctgctgagacaactaccagtactggagctgctgagacgaaaacagtagtcacctcttcaatttcaagattcaatcatgctgaaacacagacggcttccgcgaccgatgtgattggtcacagcagtagtgttgtttctgtatccgaaactggcaacaccaagagtctaacaagttccgggttgagtactatgtcgcaacagcctcgtagcacaccagcaagtagcatggtaggatctagtacagcttctttagaaatttcaacgtatgctggcagtgccaacagcttactggccggtagtggtttaagtgtcttcattgcgtccttattgctggcaattatttaa

SEQ ID NO: 31 - DNA, 8247 bp, Saccharomyces cerivisiae
atgtcccacaacaacaggcataaaaagaataacgataaagacagctcagcagggcagtatgcaaatagcattgacaattcattaagccaggaaagcgtctcaacgaacggcgtaacaaggatggctaacttaaaggctgatgaatgcggcagtggtgatgaaggagataaaacaaagcggttttcgatttcaagtattttgagtaaaagagagacaaaagacgtgcttccggaatttgcaggcagtagttcccacaatggagtactcacggcgaattcatcaaaggatatgaactttactttggaactaagcgagaatttgttggttgagtgtaggaaattgcaatcctctaatgaagctaaaaatgagcaaatcaagtctctcaagcaaattaaagagtcattaagtgacaagattgaggagctcactaaccaaaaaaagtccttcatgaaagagttggattcaactaaagatttaaactgggatttagaatctaaattaacaaacttgagcatggaatgtaggcaattaaaagaattgaagaaaaagactgaaaaatcttggaatgatgaaaaagaaagcctgaaacttctgaaaacagatttggaaattttaacattaacaaaaaatggcatggaaaatgatcttagctctcaaaaacttcattacgataaagagattagtgaattaaaggaaaggattttagacttaaataatgaaaacgacagattacttattagtgtttctgatctaacaagtgaaattaattccttacagagcaatagaactgaaagaataaaaattcaaaagcaacttgatgacgccaaagcatctatttcttcgttaaaaagaaaagtacaaaagaagtattatcaaaaacagcatacttccgatactacagtaacatctgatcctgattctgaggggaccactagtgaagaagacatttttgatatagtgatcgaaattgaccacatgattgaaacaggcccctctgtcgaggacatttctgaagatcttgtcaagaaatactcagaaaaaaacaatatgatattgttatcgaatgattcatataaaaacttactacaaaaaagtgaaagtgcatccaaaccaaaagacgatgaattaatgaccaaagaggtggctgaaaacctgaatatgatcgcgttaccaaatgatgacaattacagcaaaaaagagttttcgttagaatctcatattaaatatttagaagcttctggctataaagttcttcctctagaggagtttgagaacctaaacgaatccctatcaaatccatcatataactatctcaaggaaaaacttcaggctttgaaaaagatacccatcgatcaaagtacgtttaacttgttaaaagagcctactattgattttttactgcctttaacatccaaaattgattgcctgataatacctaccaaagattataatgacctttttgagagtgtcaagaatccatcaattgaacaaatgaaaaaatgcctggaagcaaagaacgacttacaatcgaatatttgtaaatggctggaggagagaaacggctgtaaatggctaagtaatgatctgtatttttcaatggttaataagatagaaacaccttcgaaacaatacctgtcagataaggcaaaagaatacgaccaagtgctgattgatactaaagccttagaaggtttaaagaacccaacgatagactttctaagagaaaaagcttctgcatcagattatttattactcaaaaaagaagactacgtgagcccatcactggaatacctagttgaacatgccaaggccaccaatcaccatttactatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggcgaccaatcaccatttactatcggatagtgcatacgaagacctagtcaagtgcaaggagaatcctgatatggaattcttgaaggagaagtctgccaaactaggccatactgtggtatccaacgaggcatattctgaattgcaacgcaaatactcagaattggagaaggaagtagaacaaccatctctagcatacttagttgaacacgccaaggctaccgatcaccatttactatcggatagtgcatacgaagacctagtcaagtgcaaggagaatcctgatgtggaattcttgaaggagaagtctgctaaactaggccatactgtggtatctagcgaggaatattctgaattgcaacgcaaatactcagaattggagaaggaagtagaacaaccatcactagcatacctagtcgaacacgccaaggctaccgatcaccatttactatcggatagtgcatacgaagaactagtcaagtgcaaggagaatcctgatatggaattcttgaaggagaagtctgccaaactaggccacactgtggtatccaacgaggcatattctgaattggaaaagaaactagaacaaccatcactagcatacctagtcgaacatgccaaggctaccgatcaccatctgctatcggatagtgcatacgaagacctagtcaagtgcaaggaaaattctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatttactatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatctgctatcggatagtgcatacgaagaactagtcaagtgcaaggaaaatcctgatgtagaattcttgaaggagaagtctgctaaactaggccatactgtggtatccaacgaagcatattctgaattggaaaagaaactagaacaaccatcactggaatacctagttgaacatgccaaggccaccaatcaccatctgctatcggatagtgcatacgaagaactagtcaagtgcaaggaaaatcctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggaaaatcctgatgtagaattcttgaaggagaagtctgctaaactaggccatactgtggtatccaacgaagcatattctgaattggaaaagaaactagaacaaccatcactagcatacctagtcgaacatgccaaggctaccgatcaccatctgctatcggatagtgcatacgaagacctagtcaagtgcaaggagaatcctgatatggaattcttgaaggagaagtctgccaaactaggccacactgtggtatccaacgaggcatattctgaattggaaaagaaactagaacaaccatcactggaatacctagttgaacatgccaaggccaccaatcaccatctgctatcggatagtgcatacgaagacctagtcaagtgcaaggagaatcctgatatggaattcttgaaggagaagtctgctaaactgggccatactgtggtatccaacaaggaatattctgaattggaaaagaaactagaacaaccatcactggaatacttagtcaaacatgccgaacaaatacaatcaaaaattatatcgatctcggacttcaacaccttagctaatccatctatggaagatatggcttcaaaattgcaaaagttagaataccagattgtttcgaacgatgagtacattgcattgaaaaatacgatggaaaagccggacgttgagttactaagatccaagttgaaaggttaccatataattgatacaacaacgtacaatgagctagtcagcaatttcaattctcctacgttgaagtttattgaagagaaagccaaaagcaaaggttatagattaatagaacctaatgaataccttgacttgaataggatagccactacaccttctaaagaagagattgataacttctgcaaacaaattgggtgttacgctttggactctaaagaatatgaaagactaaaaaattctctggagaatccctccaagaaatttatagaagaaaatgccgcattacttgatcttgtgctagtggacaaaacggagtaccaagcaatgaaagataatgcaagcaacaagaaatcacttattccttcaaccaaggcacttgatttcgttacaatgcctgccccacagcttgcttctgcagagaagtcatcactacaaaaaagaactttatctgatattgaaaatgagttaaaggccttaggctacgtcgcaattcgtaaagaaaacctgccaaacctagagaaaccaattgttgacaatgcctccaaaaatgatgtcttgaacctatgttcgaaattcagtttagtaccattgtctactgaagaatatgataatatgagaaaggaacacactaaaatcttaaatattctcggtgatccatctattgatttcctgaaggaaaaatgtgaaaaatatcaaatgctcataattagtaaacatgattacgaagaaaagcaagaagccattgaaaatccaggctacgaatttattttagaaaaagcatcagcactgggatatgaattagttagcgaggttgagctggatcgcatgaaacaaatgattgattcaccagatattgactacatgcaagaaaaggctgcccgcaatgaaatggtgttgttgaggaacgaggagaaggaagcattgcaaaagaaaatagaatatccctctttaacatttttaatcgaaaaggctgctggaatgaacaaaatacttgttgaccaaatcgagtatgatgaaactataagaaaatgcaatcatcccactcggatggagctagaggaatcctgtcatcacttgaacttggttttgctcgaccaaaacgagtactcaactctaagagaacctttggaaaatcgaaatgttgaagacttaattaacaccttgagcaaactaaactacattgcaattcctaatactatctaccaagatttaattggaaagtatgagaatccaaactttgattatctaaaggattctttgaacaaaatggattacgtcgcaatctctagacaagattatgaattgatggttgctaaatacgaaaagccacaactggattatttgaaaatttcttcagagaaaatcgaccacattgtagtgcctctgtctgagtacaatttaatggttacaaattatagaaatcccagcttgagctacttaaaagagaaagccgttttgaataatcatattttaataaaagaagatgactataaaaacattttagcagtatcagaacatccgacagtgatccacctctccgaaaaggcatctttattaaataaagtcttggtagacaaggatgattttgcgaccatgtcacgctcgattgagaaaccaactatcgatttcttatccactaaggcgctatcaatggggaaaatactagttaatgaatctacgcataaaagaaacgagaaactattatctgaaccagattctgaatttttgacaatgaaagccaaggagcaagggctaattatcatttcagaaaaggaatattctgaactgcgggatcaaatagatcgtcctagcctagatgttttgaaagaaaaggccgccatttttgatagcatcatagtagaaaacatagaataccaacaactggtaaacactacaagtccctgccctcccattacttatgaagatttgaaagtatatgcccaccaattcggtatggaattatgcctccaaaaacccaacaaactttctggagctgagcgtgcagagcgcattgatgaacaatcaataaatacgaccagcagtaactcgaccacaacatcgagcatgtttacagatgcactagatgataatatcgaagagcttaatcgtgtcgaattgcagaataatgaagattatactgacataatctcgaaatcatccacagtgaaagatgctaccattttcattcccgcctatgaaaacatcaagaattctgctgaaaaattaggctacaaattagttccgttcgaaaaatcaaatatcaatctgaaaaacattgaagctccattattttcgaaggacaacgatgacactagcgttgccagtagcatagatcttgatcacttatctagaaaagcagaaaaatatggtatgaccctcatttctgatcaggaatttgaagaatatcatatactaaaagataacgcggttaatctgaatggtggcatggaagaaatgaataatcccttgtcagaaaatcaaaacttagcagcaaaaaccacaaacacagcgcaagaaggtgccttccaaaacaccgttccccacaatgatatggacaacgaagaagtcgaatatgggccggatgatccaacattcacagtaaggcaactcaagaaacccgctggcgatcgtaatttgattttgactagtagggagaaaacactgttatcaagagatgataatataatgagtcaaaatgaggcggtttatggtgacgatatatctgatagctttgtagatgaaagccaagaaatcaaaaatgatgtagacattattaaaactcaagctatgaaatatggtatgttgtgtattcctgaaagtaattttgtgggtgcatcatatgcaagtgctcaagatatgagcgatatagttgtgctttccgcgtcctattaccataatctaatgtcacctgaagacatgaaatggaactgtgttagtaatgaagaattacaagcggaagttaaaaagcgtgggctccagattgcactaacaacaaaggaagataagaaaggtcaagccacggcatccaaacatgagtatgtgtcgcataagctaaacaataaaacatctactgtgtccacaaagtctggagcaaaaaagggacttgcagaagcagcagcaacaactgcttatgaagattccgaaagtcatccacaaatagaagagcagtctcatcgtactaatcatcataagcaccataaacgtcaacagagtctgaattctaattcaacctcaaaaaccacacattcatcgaggaatacgccagcatctagacgagatatagtagcatcatttatgtcacgtgcaggatctgccagtaggacggcatctttacaaactttagcatcattgaacgaaccaagcataatacccgcgttaacccaaaccgtcattggggaatatttgtttaagtattatccacgcttgggaccttttggattcgaatcacgtcatgaaagattcttctgggttcatccatataccttaactttgtactggtccgcttctaatcccatcctagagaatcctgccaataccaaaacaaaaggtgttgccattctaggagtagaaagtgtcacagacccaaacccatatccaacaggattgtatcacaaaagtattgttgttaccacagaaactaggactattaagtttacttgtcctacaaggcaaagacacaatatttggtataattcattacgttatttacttcaaaggaacatgcaagggataagtttagaggacatcgctgatgatccaacagataatatgtattcaggaaagattttcccattgcccggcgaaaatacaaagagctccagtaaaagacttagcgcatcgagaaggtccgtatctacaaggtctctaagacatagagtaccacaaagccgatcatttggcaatttacgatag

SEQ ID NO: 32 - DNA, 363 bp, Saccharomyces cerivisiae
atggtcaaattaacttcaatcgccgctggtgtcgctgccatcgctgctactgcttccgcaaccaccactctagctcaatctgacgaaagagtcaacttggttgaattgggtgtctacgtctctgatatcagagctcacttggcccaatactacatgttccaagccgcccacccaacggaaacctacccagttgaagttgctgaagccgttttcaactacggtgacttcaccaccatgttgactggtattgccccagaccaagtgaccagaatgatcaccggtgttccatggtactccagcagattaaagccagccatctccagtgctctatccaaggtcggtatctacactatcgcaaactag

SEQ ID NO: 33 - DNA, 4645 bp, Saccharomyces cerivisiae
atgagctttatggatcaaatcccaggaggaggaaattatccaaaactcccagtagaatgccttcctaacttcccgatccaaccatctttgaccttcagaggtagaaatgactcgcataaactgaaaaactttatctccgaaataatgttaaacatgtctatgatatcttggccgaatgatgccagtcgtattgtgtactgcagaagacatttattaaaccccgctgctcagtgggctaatgactttgtacaagaacaaggtatacttgaaataacattcgacacattcatacaaggattatatcagcatttctataagccaccagatatcaataaaatctttaatgcaatcacgcaactttccgaagctaaacttggtattgagcgtctcaaccaacgattcagaaagatttgggacagaatgccaccagacttcatgaccgaaaaagctgccataatgacatatactaggctattgacaaaggaaacctataatattgtcagaatgcacaaaccagagacattaaaagacgccatggaagaggcttaccagacaactgcactaactgaaagattcttcccaggattcgaacttgatgctgatggagacactatcatcggtgccacaacccacttacaagaagaatacgactctgactatgattcagaagataatctgacccagaatggatacgtccataccgtaaggacaagaagatcttacaataaaccaatgtcaaatcatcgaaacaggagaaataacaacccatctagagaagaatgtataaaaaatcggctatgcttctattgtaagaaagagggacatcgcctgaacgaatgtagagcacgtaaggcgagttctaaccgatcttgaactcgaatcaaaagaccaacaaactccttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcatataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccattcagagtgtagaacctaatgctactgatcacagcaataaggacaccttttgcactttgccagtttggttacaacagaagtatagagagatcatacgtaatgatctcccaccaagacctgccgacattaataacatccccgtaaaacatgatattgaaattaaacctggcgcaagactacctcgactacagccataccatgttacagaaaagaacgaacaagaaatcaacaaaatagttcaaaaactgctcgataacaagttcattgttccctcaaagtcgccttgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcacaccatccggtaagtatgaatataccgtcatgccatttggcttagtcaatgcacctagtacattcgcaagatacatggctgatacatttagagacctgagattcgtcaatgtttaccttgatgatatattaatattctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccaaattgctccaagattgcacagccaatccaactgtttatttgtgacaaaagtcaatggacagaaaaacaagacaaggcaattgataaactaaaagacgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttggaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacctagctggacccaagaacgttgtcgcagatgccatatcccgtgccgtatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactatatcatgaccataccttatttggaggacattttggtgtaacagtgacccttgcgaaaatcagcccaatttactattggccaaaattacaacattcgatcatacaatacatcaggacctgcgtacaatgtcaactaataaaatcacaccgaccacgcttacatggactattacaaccactccctatagcagaaggaagatggcttgatatatcaatggattttgtgacaggattacccccgacatcaaataacttgaatatgatcctcgtcgtagttgatcgtttttcgaaacgcgctcacttcatagctacaaggaaaaccttagacgcaacacaactaatagatctactctttcgatacattttttcatatcatggttttcccaggacaataaccagtgatagagatgtccgtatgaccgccgacaaatatcaagaactcacgaaaagactaggaataaaatcgacaatgtcttccgcgaaccacccccaaacagatggacaatccgaacgaacgatacagacattaaacaggttactaagagcctatgcttcaaccaatattcagaattggcatgtatatttaccacaaatcgaatttgtttacaattctacacctactagaacacttggaaaatcaccatttgaaattgatttaggatatttaccgaatacccctgctattaagtcagatgacgaagtcaacgcaagaagttttactgccgtagaacttgccaaacacctcaaagcccttaccatccaaacgaaggaacagctagaacacgctcaaatcgaaatggaaactaataacaatcaaagacgtaaacccttattgttaaacataggagatcacgtattagtgcatagagatgcatacttcaagaaaggtgcttatatgaaagtacaacaaatatacgtcggaccatttcgagttgtcaagaaaataaacgataacgcctacgaactagatttaaactctcacaagaaaaagcacagagttattaatgtacaattcctgaaaaagtttgtataccgtccagacgcgtacccaaagaataaaccaatcagctccactgaaagaattaagagagcacacgaagttactgcactcataggaatagatactacacacaaaacttacttatgtcacatgcaagatgtagacccaacactttcagtagaatactcagaagctgaattttgccaaattcccgaaagaacacgaagatcaatattagccaactttagacaactctacgaaacacaagacaaccctgagagagaggaagatgttgtatctcaaaatgagatatgtcagtatgacaatacgtcaccctga

SEQ ID NO: 34 - DNA, 714 bp, Saccharomyces cerivisiae
atgactccaaaaagagcgctaatatctcttacttcataccacggtcccttctataaagatggtgcgaaaacaggcgtttttgtagttgagattttgcggtcgttcgatactttcgaaaagcatggtttcgaagtggacttcgtttctgagactggtggatttggctgggatgaacattacttgccaaagagctttattggtggcgaagataagatgaactttgaaacgaaaaattccgccttcaataaggcgttagcgaggatcaagaccgcaaatgaagtcaacgccagcgactataaaatattctttgcatctgctggacatggtgctctatttgactatcccaaagctaaaaatctgcaagatattgcatccaagatatatgccaatgggggtgtgatcgctgccatctgtcatggaccgctccttttcgatggattaatagatatcaaaacaacaagaccattaatcgaaggcaaagctataacaggtttcccactcgagggtgaaatcgccctgggagttgacgacatcttgaggagcagaaaattgacaacggttgaacgcgttgcaaacaagaatggagccaagtacttggcgccaatccatccctgggatgactactctattacagatggaaagctagttacgggtgttaacgcaaattcttcctattcgaccacaattagagctataaacgcattatatagctga

SEQ ID NO: 35 - DNA, 2217 bp, Saccharomyces cerivisiae
atggttgccgaagaggacatcgagaagcaagtccttcaattgatagacagcttttttctgaagactacactactaatatgctccaccgaatcaagtcgataccagtcttctacagaaaatatattcctatttgacgacacatggtttgaagatcactcagaattagtgagtgagctacccgagataatatcaaaatggtctcactacgatggtcgaaaagagttgccacccttagtggtagagacatatttggatttaagacagttaaactcgtctcatttagttagattaaaggaccacgaaggccatttgtggaacgtttgcaaaggaactaagaagcaggaaatcgtgatggaacgttggcttatcgaattagataattcatccccaactttcaaatcatacagtgaagatgagactgatgttaatgaactttctaaacagctagtccttctcttccgttatttgttgactttaatacagttactacccacaacagaattataccaattattaataaagtcttataacggcccgcaaaatgaaggaagttccaatccaataacttccacgggcccactagtaagtatccggacgtgtgtccttgacggatctaaaccaattttatcgaaggggagaatagggttgagcaaaccgattattaatacatattccaatgcgcttaacgaatcaaacctgccagcccatttagatcaaaagaagatcacacctgtatggacaaagtttggactcttaagagtctcggtatcatacagacgtgattggaagtttgaaattaacaatacaaacgacgaattattttcagctcgacatgcatctgtctcacataactcacaaggaccccagaatcagccagaacaagaaggacaaagtgatcaagacatagggaaacgccaaccacaatttcaacagcagcagcagccccaacagcagcagcagcagcagcaacagcaacagagacaacaccaggtccagacacaacaacaaagacagatacctgataggagatctctttcactttctccttgtacaagagccaattcttttgaaccacaatcttggcagaagaaagtctatccaatatcgagacctgttcaaccatttaaagttggttcaattggaagtcaaagtgcgagcagaaatccctctaattcatcgtttttcaaccaaccacctgttcataggccaagtatgagctccaactacgggccacaaatgaatattgaaggtaccagtgttggaagcacctcaaagtattcctcctcctttgggaacattcgtcgtcactcaagtgtaaagacgacagagaatgctgaaaaagtatcaaaagctgtaaagagcccactacaacctcaagaatcacaagaagatttaatggattttgttaaattactcgaagaaaaacccgatctaactataaagaagacaagtggaaataatccacccaatatcaatatttctgattctctaatcagatatcagaatttgaagccaagtaatgacttattaagtgaagatttatccgtaagtttatccatggatccaaatcatacatatcacagaggcagatcagattcccactcaccattgccttcaatatccccttcgatgcattatggatcgttgaactcgagaatgtctcaaggcgccaatgcaagccatttgattgcaagaggcggtgggaattcatctactagtgccttgaatagtagaaggaattctttagataagagctcaaacaagcagggtatgtcaggcttacctcctatttttggtggagagagtacttcatatcaccacgacaacaaaatacaaaagtacaaccaattaggagtagaagaagatgatgatgacgagaatgaccgtttgctcaaccaaatgggaaacagtgctacaaaattcaaaagttcaatatctccaagatcaattgatagcatttcaagttctttcataaaaagtaggatacctatcagacaaccataccattactctcaaccaactactgcgccctttcaagctcaggcgaaatttcataaacctgcaaataagttaatcgataatggtaataggagtaatagtaacaataacaatcataatgggaatgatgcagttggtgtgatgcataatgacgaggatgatcaagatgatgatctagtatttttcatgagtgatatgaacctttctaaagaaggttaa

SEQ ID NO: 36 - protein, 1354 aa, Saccharomyces cerevisiae
DPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITKAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTDLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDETDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIAMSSDFYSEFNKIMKYHERVVKGKESLKEVYGEEIIGEVLEREIAMLESIGWAFFDFGEHKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 37 - protein, 1900 aa, Kluyveromyces lactis NRRL Y-1140
MNPQPKETNRSSISSGARNSAGSASSNNSISSKNSGRELQPRSDTDSEWQDVGMPTFKEDYSIDAITKKVKPGKKGFHSAIVRDAGSFAHNPQPPLAKPVKPTFERSRTANLTATSSRGNLPLLSRTSSTLSVSTATSHGHKGTTKPSRATNFFKKLTSRKSSLASQGGPPDSDNQISQGGRVSASDGEQQSPFHQQSLQQQVPTNALRRKMSTFIHGSSTMSAASTLTSANAPHMKHSGSKGSSLLHSGNEASNGSNLSGGNATSGVSNQQHGVSSAGRSIDTDLSRRNSGTSFDASKLSAAKEIFGVDLDLDKLSDMTDVVVTSNAPSAETTDKVPPKSPNASQDTKDATLALRKQWTAPESWDVDETVGLDVNKIKERHKMSKANRHRGKNRKRYSKSQGKHTKGSVPKNVIAKDTSEPVIPHVHHHDFEEDALSPRTSPPNRGSNDESGLHLSETKSSECDLCFTISPNGDEDSDISIETQSESLDDITSAKTQSRPGSPLSQKNIEQYTELDGETEYEEHMLEKYYSDLSDIDQTKKYAIRIFNVDDTFTTLSCRPNTSVAELIPQIKKKFNIQQGNFQLSLKVGKLSKILRPTANPILIQIKLLLLNGYKKSDPLHILGLEDVSFVFSFKFHPVTTSQLTIEQQQRLSKGDFIHVDLRNMDLTTPPIIFYQHTSEIESLDVSNNANIFLPIDFIESAVKLSSLRMVNVRASRFPANITQAYDLVSLDLERNFIKRVPESISKLSNLTILNLQCNQLDRLPSGFKNLKNLQLLDISSNAFTAYPEVINRCTNLLQVDLSYNKINSLPLSINELSKLAKMNLSNNKIQAVPDLSGMANLRTLNLKNNRIATIKSNAPNLQNLFLTSNRISVWEDSLPKLRSCDLTENPVTSFDYRGNVLSNLTSLSLNKAKLSSLPIDFLKTLEKLEKLELNDNNLTSLPAEIKYSKKLIHFSAANNKLDSIPEEIGELSNLKSLDLHCNNIRELPISIVNLELTTLNFSSNLLGYNPGLEDYENTPLSKSLLFLNTADNNLNNEMLPLFNFNTSLKIINLSYNDISDISALNLPSLTELYLSGNAITSLPGEVFQRMKNLKVIMLNGNKLMSLPSELSQLSNLTVLDVGSNQLKYNISNYHYDWNWMNNLNLKYLNFSGNKRFEIKSMIGPDTKTDLSDLTILKQLKILGLMDVTMKTSKVPDDGVNFRLRTTGSMINGMKYGVADTLGKKSSVSTRDIKYERFRGKDDECLFCLYDSVNENASSGHKISQIIRDIYDKILTRALEKYGDDTDENIRTALRFSFLQLNKEINGMLVSVENGLNKSELTTVDLLSGASATVVFFKGKSVYTANIGNIGAILAKNNGDYEVLTRLHVPTKRDEYERIRIAGGYVNSEKLDGVSEVSRAVGFFDLLPHIHASPDISDFKLTFSDQMIIIASHNLWNYIGYEIASDIARENGSEPMLAAEKLKDYAITYGCTDKLTVVCISVEKGATETNRFNISKKDLLSRKTAFEDSSLRRLQPEIPPPTGNVAIVFTDIKNSTFIWELFPDAMRTAIKTHNEIMRRQLRIFGGYEVKTEGDAFMVAFPTPTSALVWCLSVQLKLLEAEWPGEITSIRDGCLITDTSGNKIYQGLSVRMGIHWGCPVPEVDVVTKRMDYLGPVVNKAARVSGIADGGQVMLSNDFMVEFKKILSYHQQVTEDNIPLAKAYGEDIVGEILEREIHILSSIGWMFVELGEQTLKGLETKELVTIAYPKSLQARHTLATQDQNNSVISDDFLFQIRSVSNRLETVLSSVQGGLIGLENSANGRYTTFDSNTKQAVMKNSSEADLLAFLDHLITRIESSVVLMNLRQQVQGGLTIYKSGDAMKQKSIFQLLDDLLARNQLYIENSHNDESEQQSFKSFPEE

SEQ ID NO: 38 - protein, 1692 aa, Schizosaccharomyces pombe 972h-
MDQSKRLLKSAVPNPPEHFKTGISWLDDLDEKDDDSATSVNYDIPEITEANLCNDSHEALSPCTQPVGNSGRPVEAFKTYPSTPAVPSKSVLFHFYEPDENFSLSDTGRTKSDTALAARESSEKSEVPRDTRSAGIKPYKENNSSNCAISKEAGLRRLIDKDRESFDKNLNQSFTNLTFPEPISDDSDSVEFQRDSLNNNWPASLEGSIHELPRNSDDDGIPASAAHILDLDYHRDSYDSPWKKFLPYPSILSDDSWKAPESWGTSLPTEAIPKQVFTTRFFARPSLGNRKKEFFLRVYRDDRTSVSFICPIGIQTHEVIKLLARLFFLPSSANFYLLLIQFNTERILLPHEQPCIIFERLLSLFGCKVTSDEEINEEDNYSVARLVFTTMDIGADVLRKFSEKKITANLDISRSNLEVIPVKIYPYAHELISLNVSHNLSLDLPLDFMERCVKLKRLDISNNLRSPRGKPITALRQLEVLNMSRNDIYELDPLIFSGLSRNSLKELNIANNKLFFLPHSTRYLVNLTYLDLSYNNFVTFPLIITELSQLETLNFSHNLLSQISSKIGSLVKLKHLYLQFNDLSNRLPQEIGLLKNLETIDLSYNAITNIASLSECPKLNSINVACNLLSFYEYSNPSATFIDFSFCPLTTIDPAFSYSNLVYFDISHAKLIGLKDSVIETLVNVETVKVNYNHFTSISDAISAMQNLKYLSCTNCEMSYVSPNLGKLKHLVHLDLHANNIKIFPEEVWQVSSLKVVNLSSNILEKIKLPVATSKKLTRTISQLKIMRTLSGNPVSSLSSQEFVMPTVEELYLVDNRLGNDCFTALEYFKCLKVLNLSYNYLTEIPSKFFQNFSDLKHLFVSGNELANLSISSTAQVLLETLYANGNRLSSFPKNEALSKSLRFLDISTNNLQNLAVEKAEKKSLTKLPQLEYLNLSGNTWFRFSEHEDTNFTKSYLKNLKFLSIMDLNTKFSNAPSDVLNHFIQRNSPQPNILRYGVCGYLSRSIPVISACELVVNNFLHPQSSLYCVLDSDISAGKNNRVLKFVYDNLASCLAHEINAADSSSEQICNALRRGFLRLNKKLGNVIHYDLRKSSEGDVDSNYVTTMNISEKGYSMDSSCLDIGVSIILVYVRDTRAFVANVGTSMAIMSTRNDSEPTTLSVMHDVYNRDEIRRIVDSCGFISGEIKSTTTRAIGRLSQFPGVQAVPYVNVQYLSELNEFIILANQEFWSVLSKRTVIDVVRANRHSPLLASTKLRDYAIAYGAEKNVLVVIVELNGLFEENSLNFNQLRGDEKTLAISEKNDNMSFVQDLPDDSSLARMNREVSPPKGCIAMVFTDIKNSTLLWERHPIAMRSAIKTHNTIMRRQLRATGGYEVKTEGDAFMVCFQTVPAALLWCFSVQLQLLSADWPNEIVESVQGRLVLGSKNEVLYRGLSVRIGVNYGVTVSELDPITRRMDYYGPVVNRTSRVVSVADGGQIAVSAEVVSVLNQLDSETMSSEKTNVNEMEVRALKQIGYIIHNLGEFKLKGLDTTEMISLVYPVQLQGRLERLIKSRSLGTPTALPETQTYTPVRSRSNSLRPMLARLSDSKSVHGEEGGSGKRSVSSLRNVSPSESTGGYEGCIFDDQQYQLLYELCERLEDHAAILHGFPEPPPCDTGLAAPVNQAEEYSLFYRLTLRIENTIYCVSQMLGHTG

SEQ ID NO: 39 - protein, 2052 aa, Yarrowia lipolytica
MDPLDIGNSQPREGWNRLNAFSNDGVSPTSNSYDHDELPPSPTSRTAFTGIDPDYEFAPKWEPGHGNNNSSIDDPLYSTLDPHARANASLTRSAPGPPPPGQRPPPERPTVITPVGTHTPSAGGSRAVTPISTNVDRRPSYASQGTTGSTGSKKSIPQKVMDLFVSDDTSADSDGQSSSSKKHHKVKLPRPSKSMFFFKKHDDDDSRSEHSRERTERTSHPGDGHQLRAARSFNKPDHGIFHKAATSNHFDDSNSIHRATSHSTLPSGDEDDTLIALAHKAKKSSKNIIGKVFHHKDKKKKSHTFDGPINPLESHAQPFRNASVASVPEPHAPKQQPTMRSASTVSHLDPHRNSSTSSRDHMASSSRDHTASSSREQVLNMISKRPSLANANFYNLDTDLDSMAGIVEDGGASSSANSSALPRHASTGSAAADSIPGMPVLPGGSISGPMGGPMVGDRSSVSTNNNTNNANNANNSNHNSVSGVASPTPVVNTANASGTTAAPVIGVGTDLSFIGNDDTAPQTNAGQWSAPESWAVADTGPGGGSKLEPEEIVETYADPTREQYGLETNVSTHIPGKPPINYFVRIFRQDDSFGTIVCPLETTVSELIQILGKKFFLPSVKGYQLCVRIGGLTRVLDLLEKPLLYQKILLEFMGYTEKDRLVEVGREDLSYLCRFLFLPSSIQTFTPEEEAIMSRDYVHADLQNLELQTIPIIFYQFSNEIEYLDVSNNPSISIPLDFIQSCINLKNLRFSGNRSRFFPVNISHAVFLEYLDMSRNMIKDVAQIRFERMSALTTLDLSCNQLTRINNNVALLKQLRRLSLSNNNVTDFPMAVCNLSNLIELDLSFNRLSSVPASISKLVNLERLVLNNNYISKLPNDIKNLVQLKELDVRYNRLNNVDALSSLPLLEVLYASKNQITSYEHNFESLQCLYFDRNPFTEVNVSNVLHTLTVLHLSKAKLSTLPENFFDRLPNLEKLVLDKNHFVSLPSSLGSLRKLIYLSAVGNNLSVLPSSIGQLTTLQFLDLHSNNLRKLPDEIWNLNVLSTLNVSSNLLDSFPKHKFHVSSVSSGDAFHRNLESEFDSNYEMRIRRPSAFSITSTLSPGETSRRGSLAYNSPKMSTSPMTFARDAPVSSRTTLANSLLILSLADNRLNDECFEELSLLTSLQVLNLSYNELMDIPYGALRRLNRLTELYLSGNNLTSLPADDFENIKTLRTLHVNGNKLHSLPAELGKILHLTVLDVSSNQLKYNISNWPYDWNWNWNLDLKYLSFSGNKRLEIKSAANNLMRHGDGTEQKNLSDFTVLSQLRVLGLMDVTLTTPSVPDQTENCRVRTYGSELNNMPYGMADSLGQHENLSIIDMVVERFRGNENEVVVGMFDGRNEINPRAGNKVAKLLQEMFGALLQDELKKMRDDDTIEDALKRSFLAANRDIGAAALTTVESHTAHRSSTTTHLNKQDGLTGSCATVCYISDNKLYVANVGDSMCILSKGTGEHRLLTTRHDPTEPEELGRVRAGGGFISAHGKLDGVCDVSRAFGFYNLIPHIQARPDIVSMELNDSDELLIIGSKQLWEVMSYETAVDIARTESQDPMLAAAKLRDFAISYGASDKLMVMVLGIGVKRRTANQSNLISGLPPVGEDELFQPYRKRRDKSLLPEDSNLARLGSEVDPPEGEMAMVFTDIKNSTLLWETYPIAMRSAIKIHNAIMRRQLRILRGYEVKTEGDAFMVSFTTPTSALLWCFSVQQQLLAADWPAEILESEEGYEVRDDEGNVVFRGLSVRMGIHWGSPVCEPDPITRRMDYFGPMVNRAARVSAVADGGQITVSADFISKVKKLQSLREKMNAENISLGEAFNDEITGQAITQNLDMLDSLGWIVKEIGELKLKGLENPEFLSLVYSAPLASRHGMQEDLLHPKKKAGGFTSDLLSQVLEIALRLEHMCARFNGQSRPVSLKDIQRHAIQHIAPTPESELGVYFENIVTRIENAIMMLCMRHTVARAGGFDPINIDNVNTSASTHGVEIGQLLDAVAQLTGIRYVPEGQQYHERQPEMESSVQVEEIN

SEQ ID NO: 40 - protein, 2155 aa, Sclerotinia sclerotiorum
MTRKDGSYRNSSATSSSTGSWKSTDTIKGPGSSYFQGSSTKRGAPMQVKTDRTSRVENDAQVSPTSAGPRNTISPSSSISPNVSPREQRMAADFGNYRRDLAVLETSGGRIPQIHHNPPTAIASTNPITPWMSTGSSATGSPNGFTSFYNDSSDALSQASQLSPIARPGTAVTGHTNTSESPADAFFGDGDERRPSVASITTASSTGSKSSLGRAVGGLHKKLTSFFGEDLPSSSETSLPSQGKEVRSHSFARSHRDRNHSSATDHGHYRDASPAGGSRPRTPVPSSEVVPFLYQNSQDITLYGEAPVRENLSGPDRERYINDSSDKPPKTSSSAKSHHLPGHHLRNRSNDDTRSLRPTVSREESAFSMRFKDRNNNPMGTAAANASNPNLQRPKSPTPSGMSTWSQTTKGGNSDGPSSPRDNNNGTKRSLLNLTGRFKRHKDKDHTPSRLKETPAASRAPINGSSKQDAGKIYESPDLAKYSQDGSITGSELNLPSQSTNGNARPPGGRQGTFPKLPFRKGRGNKGAEDSDQLYDTSDRSGDNVHHLDTNLSNMEGILTKPPPLTPLDNSIFNGEEDEGKEETESLGGLGWNAPDSWAVKKIDDDNMSRLPEIDEAGIPQKAEEKANPYCIRIFKADGTFATLSTSLNTTVTELLAQLNKKTYQADSLDNYQIVMKKHDLQRILAPGERPLVIQRRLLEQAGYQPEDRIEDVGREDNSYLCRFSFLPARQGGYASVSNDNGLGRVQKFSHVDLSGKNLITIPIALYSKTSEMISLNLSRNLSLDLPKDFISSCVNLREIKFLSNEAWKLPASLSRANRLTILDVSNNRLEQLEHAELSRLQGLISLKLANNRLKSLPSYFGMYRSMRTLNLSSNFLEEFPEFLCNMTALIDIDMSFNGISNLPNEIGKLKHLERFVITNNRLKGSLPNTFGELVNLKEVDVRYNMLSSIDIIATLPKVEQISADHNSVSVCECEFAKIRILRLNSNPVTKFEIKNLVPTLTTLNLSNAKLAQIPDAAFDKMPNLNKLVLDINHFVSLPAQIGKLRKLEYFSIARNALSSLPAELGCLTELRYLDIRQNNLKKLPMEIWWANKLEFLNVSSNVLDNFPKPGSRPPQPPGDVGSTNSNNTGANSQNSSFEELGPLDFAHRRPSQASSGLLSVGSSPVPDARKGSVVSVYGKGGRKTSVVSRSTSASTINHQTPTNIRKDSGLSAKLINTFAGSLKILHLADNGLDDDVFDEITLLSELRVLNLSYNDLNDMPSRSIKSWPQLVELYLSGNELTSLPSDDFEEFSLLQVLHINGNKFQTLPAELGKAHRLQVLDCGSNSLKYNVSNWPYDWNWNWNTNLKYLNLSGNKRLEIKPSLPGSAAARDGRDLTDFSALQNLRILGLMDVTLTIPSIPDQTEDRRVRTSGSLAGQLAYGMADSLGKNEHLSIIDMVVPRFNSTETETLLGMFDGQALSSGGSKIAKYLHENFGHIFSEELKRLNALNNETPKDALRRAFLSLNKDLATAATQNTEERSLLSHRGSATPAVLSQADLISGGVATVMFLQQSELYVANVGDAQAMLIHEKDGHRILTRKHDPAEPNERQRIRDAGGWVSRQGKLNDVLEVSRAFGYVQLMPAVQAAPNVEHITIKEQDEMVLIASRELWEYLSPELVVDIARYEKHDLMRAAQRLRDLAIAFGASGKIMVMMMGVSDLKKRAQIRPHRVQSLSFNPNMMMEDGYVPSKRPKKKTDDVDDSMLRRLQAEVQAPVGDIGIVFTDIKSSTALWETYPSAMRSAIKLHNEVMRRQLRIIGGYEVKTEGDAFMVSFPTATSALLWCFAVQSALLEVNWPAEVITSNMGHEVYDSNKNLIFKGLSVRMGAHWGRPVCENDPVTRRMDYFGPMVNRTARISAVADGGQITVSADFISEIQRCLETYSESDRSGSTGSEDAFDSDFISHSIRRELRSLSSQGFEVKDIGERKLKGLENPEYIYLMYPHALAGRIQFQRSLESGEAAVVEEEPATLARDSELSIDTENVWDIWRLSLRLEMLCSTLEEPRGSALQPPETAMLEKMRNRGGEVSDRFLLSFLTHQVSRIETCTAALATRHLVIGQSLISDLDQLRAPMAGIIEGLAADLQELQKYRAMYGPLEPLEPLEPSVYEYEDEDESEDL

SEQ ID NO: 41 - protein, 1690 aa, Candida albicans
MSFLRRDKSKANFRDGSATGLEEPVSPTTHFSPNAPPPLDGNHGDHYHDPDSPRSSVVSLPQLIHNSATHHLKENYRGFHANKRPKGIANVPPLAQPIKPRFKKKSNSLLNKLIYSTKKEDDETATSGKESRSSSIISDEKRKSASSASSGSSRQKFRFSSFDSNLSTSSSSPPKDKKVSVSDTVSDSSTVTASMSNMPTISIDLNLDEMHDIIKSPETPTPTAGLPTQKAEKKASPTAIKNWQAPESWDVKAPIKKEEPHAPKIEEVAENDVAIDNVLEKKRLPVLYGTHQVPHVTNSKDIKSSHIIRVFKEDNTFTTILCPLETTTSELLAIVQKKFFLESTTNFQLSVCIGNCVKVLEDFEKPLKIQMGLLLLSGYTEEDKLRMLGREDLSFVCKFVVENIFLRSLTHDEEVLLSRNYVDVNISSLNLKNVPIIFHQHTYEIEKLNVANNPSIYLPLDFIQGCTNLAYVDFSHNGCSKFPNNLLEAPQLTHLNLEMNFLDEIPQRISCLSNLTNLKLSSNQLYSLPHSFSTLTNLKQLDLSSNYFDSYPEAVNKLTNLVELNFSYNDLSIIPESIANLINLQKLNLCTNKLSGTLPGYLSQLKALKRLDIRYNYISNVDVLGIIPNLEVAYASKNAISTFSDQMKCLRLLHFDRNPITELKFNTQMQMLSVLDLSRAKITAFPAEFVEKVPNIEKLVLDKNHLVSLPNELCQLSKLVSLSVHANNLQSLPANIGDLRFLKYLDLHSNNLKSLPDQIWDLCHLTSLNVASNNLTSFPKAPYSVVKRLSSSLVDVHLESSQTLSLADSLLILILSDNRLSDDCFDEISFLIALKSLNVSYNDLIEIPQGTLSRLTRLNELYLSGNELTTLPADDLEVLKSLKLLYMNNNKLVSLPAELSRIANLQHLDVSSNQLKYNISNWPYDWSWHWNKNLKYLNFSGNKRFEIKQSHIKNPETGEDFDSLLVLKQLRVLGLIDVTLTTTNVPEQAVDLRLRTTASEFDNFGYGVSDSLGMRDHVSARDLFVQKFRGKENEMLLCAFDGKHGATNQGHRISLVAKNMFVRNFTKELDEIKNDDEIENALRKAFLNFNKEINGILTAKKNKSFTPVPNMSKEALELNLVDDGNAGCTVSVIYIKDKKLYSANIGDIEALLCRNNGDQFLLTEKHDPTNREEFERIRASGGYVSGGGELDGQLSVSRGVGFFNFLPHTHCGPTIRRFKITNDDDMIILGSKQLWDFISYESAVDIIRKDKNDPMVAAQKLRDFAICYGATDKICVIVLTFGNRQKQAANMYSNYGVDRRRRDKQQVVGGDSNLRKLEQEIEPPIGPLALVFTDIKNSTLLWDSYPAPMRSAIKIHNTIMRRQLRITGGYEVKTEGDAFMVAFPSPTAALLWCFQVQQNLVTADWPSEILETDQCCVVSDSENNTIFRGLSVRMGIHWGSPVCEPDVITGRMDYFGPMVNRASRISAIADGGQIAVSSDFLDVLNSLTVKHNNIKNNVESLIDAYQGNENAGMTIERELNALEDLGCNYFKIGERKLKGLETPEPITLVFTNRLKLRYDIFQKRLDANHSTRVAGTLPVEIIYGLRTVSLRLENLCSSINNGGNYCSEGFESSSGVISQKMNSSFKDSDLISLLNHVTTRIESCTTTLFLRQQLSQIKGNGGLIETNNSPSLDVIMDEVADIMKTVNELK

SEQ ID NO: 42 - protein, 2152 aa, Aspergillus terreus NIH2624
MASSGGDYPEERHSSESSGAHSWHSWMSQETVRDGQTDRRPPNQPMSNGRSLSPFPPSARADRSRSQGRKPPPPALGPATEFNTSMFSRASPDVSPTDLRKGSGFASHRKALAMLGADDPGPPPTSSSGSGPSHLNPHQFDYFQQNPNSSRPSSPKMAPTDSSGTFFHDSEHEASPATASFRPGTGRTYASEPLEIDYNMDNRRPSVASATTVSSQGSKSSTSARFRKKLQGFFGDEYLGPGEPRPESDHAAQLQSGNPSHIEQYLTRERANSDGTRPVPGLANDDSSSQNPPAHTPLPSSEITPWLYQSFHDIPQYGEAPVREAPTDSRTAANAKGWQKEPARRHLGGHRHSRSKEEKPTVAGDLAGYPARPSTGRDDLSLGLRPSREGSFNNYPAAMNSTSTLVGRSTSPTPSVQSAYAREQGQNSPGPGQNKRSILDKIRRPIGHGPLKHFPGAKGAHDTTKASSKPSRRDPSPARRGRQGSLESGLSTPRYLDASDSDRKRDPRIVLGSAKMRNRRPGTETPAREAKGDEQSMYSLDTDLSHMEGIIKDQNAAISADRNRSINGASFEDQEGRIGHWDAPESWHVKKHGDENTARLPTTAQATARAAPDADGISYFIRVFRIDSTFATLSTGLNATVADILVLLGRKSFLTEHLNNYEIVMRKNDLSRQLDPGEKPILMQKRMLEQIGYTQKDRIEEIGREDHSYILRFTFLPTKLSGLSSLQGEPGFNKMQKFSHVDLQGRSLVTIPITLYKKASEIISLNLSRNLALDVPRDFIQGCINLREIKFIGCEAEQLPASFGLASRLTYLDVSNNFLENLSHANLDRLHGLVLIKLANNRLTELPSYFGAFEFLRSLNISSNNFQVFPEFLCNLKSLVDLDISFNNISELPNIGKLSTLERIWMTNNVIKGPLGETFKDLVNLKEIDARFNEITNIDNLCLLPRLEQLQIGHNAVSKFRGSFPKLRTLLIDHCPITQFDIDGPMPTLSSLNIASAKLVQFRDSLFENLPNLTKLVLDKNHFVSMSQHIGKLRRLEHFSMIKNPLASLPATIGCLTELRYLNLRECNLSRLPSEIWYCLKLETLNVSSNVLDSFPKHGGPPPQPPTESGGTPLPTPGISTTPSYEELGALAEQEPRRPSQTSGGVLSTGSSPNGGYRKPSVASSLGQSGRKVSAARSVNEGSPSSRKDSNFSQHVATTFGGSLRNLYLADNRLEDDIFRELSLIPELRVVNLSYNELTELPQGLLRRWPFLTDLYLSGNELTSLPSDDLEEGSNLKVLHINANRFQVLPAELCKVSKLAILDVGSNSLKYNVTNWPYDWNWNWNRNLKYLNFSGNKRLEIKPNISSLGSPAAQGTDLTDFNSLTHLRVLGLMDVTLTTSTIPEESEDRRVRTSASLAGSLAYGMADFLGKSEHLSIIDMIVPRMKPDNIETVVGMFDGQSQSTGGSRIAKFLHENFLQTFSGELKRLRPDEQESPLDALRRSFLALNKNMAFACYRSLDEDVRQYHEDAADQKKVRLTKDDIRSGGTATVLYLRNMDLYVANVGDAQAILVKSDGSFRHLTRNHDPAESHERARIRAAGGFVSRHGKLNDILSVSRSFGHFLLMPAVIAAPHTMHVNLTEQDEMIILASRELWDYVTPDLVVDVTRAERRDLMVAAQKIRDLAISFGATNKLMVMILGVGDLKKREKRIRNQSVYLGPPEEQLITSTKRPKKPANMPGDSRLARFDYVDAPVGELAIIFTDIKKSTSLWETCPDAMRSAIQIHNDILRRQLGIIGGYEVKTEGDAFMVAFSTTTAALLWCFNCQTQLLEAEWPTEILEQPQCQVQYDMDNNIIFRGLSVRMGVHWGEPVCEKDPVTNRMDYFGPMVNRASRISAVADGGQIFVSSDFMSDIQRNLEVFADSERAASTGSEESYAMDNLGYNIRRELQQLNSQGFVIKDQGERKLKGLENPEPLYLIYPHSLSGRLTTLEQNAAPENAPTTISKHSQLEIQTDLIWRLWEITLRLERLCGALEYPGETRLKEPNVALFNVVKNHGGELADSTVVSLVEQQVTRIETTITTLSIRHMLRPFGPGDGLADHAMPIADVLQELQTQLAEYRALKGQTSAGAAGITGMSPGYASTDVQYPASSPSSSSLLHMGHSSHDLNSNGSHS

SEQ ID NO: 43 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 44 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 45 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 46 - DNA, 1692 bp, Saccharomyces cerivisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 47 - DNA, 1692 bp, Saccharomyces cerivisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 48 - DNA, 1692 bp, Saccharomyces cerivisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatcagactaattgaactgaaactgcccgtctttgatgctccggaaagtttgatcaaacaagcgcaattgactgccgctacaaatgccaaacaataa

SEQ ID NO: 49 - DNA, 1692 bp, candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 50 - protein, 564 aa, candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 51 - DNA, 1788 bp, Pichia stipites
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 52 - protein, 596 aa, Pichia stipites
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 53 - DNA, 1707 bp, Pichia stipites
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 54 - protein, 569 aa, Pichia stipites
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 55 - DNA, 1692 bp, Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtgctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctcacttggttctatcggtcggtgctctattgtccgatttcaacactggttctttctcttactcttacaagaccaagaacattgtcgaattccactctgactacaccaagatcagaaggcctaccttcccaggtgtccaaatgaagttcgctttacaaaaattgttgactaaggttgccgatgctgctaagggttacaagccagttccagttccatctgaaccagaacacaacgaagatgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgcatccaacgctaagaactaa

SEQ ID NO: 56 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 57 - DNA, 1716 bp, Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 58 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 59 - DNA, 1716 bp, Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 60 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 61 - DNA, 1689 bp, Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 62 - protein, 563 aa, Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 63 - DNA, 2886 bp, Saccharomyces cerivisiae
atgataactgagggatttcccccgaatttaaacgcgttgaaagggtcatccttactagaaaagagagttgattctctccgacagcttaacactaccacggttaaccagctgctggggttgccggggatgacctctacattcacggctccgcaactgttgcagttaagaataatagctataactgcgtctgccgtgtcccttattgccggttgcctcggaatgttcttcctttctaaaatggataagagacgaaaagtcttcagacatgatctcatcgcatttttgataatttgcgactttcttaaagcttttattctgatgatttatcccatgattatccttattaataatagtgtgtatgcaacacctgcattttttaataccttgggttggtttacggcctttgccatcgaaggtgcagacatggccataatgatattcgccatacattttgctattttgatcttcaagcctaattggaaatggcgaaataaaagatcgggaaatatggagggtggcttgtacaaaaaaaggtcatatatctggccaattactgcattagtacctgccattttagcaagcttagccttcattaattataataaactcaatgacgattctgacaccactattatactggataataataactacaactttcccgattctcccaggcaaggtggctacaaaccttggagtgcatggtgctatttaccacccaagccgtactggtataaaattgttttaagctggggtcccagatatttcattattattttcatatttgcagtctacctcagtatttatattttcattaccagtgaaagtaaaagaattaaagcgcaaattggagactttaaccataacgtactagaggaagagaaagaaaagaaaaaattatttgggctcggtcactggggaaaagccaaatggtatttcagatcctattttaaattgccattgctacatcttttgagaaatttaaagaattttttcaccatttcgttcatagatccgaatgaggaaacagacgattcaggtagtagtaatggaactttcaattttggtgagagttcgaatgagatacctacactattcagaaaaacaaatacaggtagtgatgagaatgtctcggcaagtggtggagttcgcttacttgactataacagtgctaaaccactcgatatgtccaaatatgcaatgtctgaacagccagatttggaaagaaataatccttttgattgtgaaaatgacatcacactcaatccttcggaactagtatccaagcaaaaggagcataaagttacttttagtgttgaaaatgaaggactggatacaagaaaaagttcaatgctgggacatcagactttctcttgccaaaattctctagaatctcctttagcaatgtatgataataagaacgataacagcgacataactagtaacattaaggaaaaaggaggcatcatcaacaacaacagtaacaacgacgacgacgacaacaacaacaataacgataacgataacgataacaataatagcaataataataataacaataataataataacaataataataataacaataataataacaataacaacaacaacaacaataataataataatagtaataatattaaaaataacgttgataacaataatactaatccagccgataatattcctacactttctaatgaagcatttactccgtctcaacaattttcacaggagagagtgaataataatgcagacagatgcgaaaattcaagtttcaccaacgtacaacagcatttccaagcccaaacctacaaacaaatgaaaaaacgtagggcacaaattcaaaagaatctaagggcaatattcatttatccactgtcgtatattgggatatggcttttccccatcattgcagatgcgttgcaatacaatcatgaaataaagcatgggcctaccatgtgggtgacatacattgacacttgcgttcgaccattaagttgtctcgtcgacgtcattgtttacctgttcaaggaaaaaccttggaactattcatgggcaaaaacagaatcaaaatatctcattgaaaaatatattctgaaaggagagcttggtgaaaaggaaattctgaagttttgtcacagcaattgggggaaaagaggttggtattatcgtggtaagtggaagaaaagaaaatgctggaaatattctacaaaccctctgaagcgtatactgtggtttgttgaacgcttctttaaacaattgtttgaactaaaactacactttagtttttatgacaattgtgacgattttgaatactgggaaaactactattcagccaaagattcaaacgataataaacgcacagaatctgatgagactaaaacgaatagtagcgatcgctcccttccatcaaattcacttgaactacaggcaatgcttaataacatcacggccgaagaggttgaagtgcccttgttttggaggatcattcatcatattccaatgcttggcggaatagatcttgatgagttaaacagattgttgaaaatacggtacaataacgaccatttttctctacccgggttgaaatttgcattaaaccaaaataaaagtcacgataaacatcaggacgtctcaactaacagtatggtcaaatccagcttcttttcaagcaatattgtcacaaacgatgatgagaatagcattgaagaggataagaatttacgctattcagatgctagtgcatctgaaaattatctggtcaagcccacaataccaggtacgactcctgatccaataattgaggcgcagaacgataatgatagtagtgatagtagcggcatagatttgatagccttcttaagaaatggaccattataa

SEQ ID NO: 64 - DNA, 1350 bp, Saccharomyces cerivisiae
atgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatga

SEQ ID NO: 65 - DNA, 930 bp, Saccharomyces cerivisiae
atgcagggaaataaatcaactataagagagtataagatagtagttgtcggtggaggtggcgttggtaaatctgctttaacaattcaattcattcaatcatactttgtggacgaatatgaccctactatcgaagattcttacagaaaacaagttgtcatcgatgacaaagtatccattttggacattctagatactgctggacaagaagagtattctgcgatgagagaacagtacatgaggactggggaaggtttcctactggtctattccgtcacctctagaaattcctttgatgagttactgtcttattatcagcaaattcaaagagtaaaagattctgactacattcctgtagtcgtggtaggtaacaaattggaccttgaaaatgaaagacaagtctcttatgaagacgggttacgcctggccaagcagttgaatgcaccctttctagaaacgtctgcgaaacaagccatcaacgtagacgaggccttttatagccttattcgtttggtaagggacgacggtgggaaatacaatagcatgaatcgtcaactggataatacgaatgaaataagagattcggagctaacctcatctgcaacagcggatagagaaaaaaagaacaacgggtcttatgtactcgataattctttgaccaatgctggcactggctccagttcaaagtcagccgttaaccataacggtgaaactactaaacgaactgatgaaaagaattacgttaatcaaaacaataacaatgaaggaaataccaagtactccagtaacggcaacggaaatcgaagtgatattagtcgtggtaatcaaaataatgccttaaattcgagaagtaaacagtctgctgagccacaaaaaaattcaagcgccaacgctagaaaagaatctagtggtggttgttgtataatttgttga

SEQ ID NO: 66 - DNA, 969 bp, Saccharomyces cerivisiae
atgcctttgaacaagtcgaacataagagagtacaagctagtcgtcgttggtggtggtggtgttggtaaatctgctttgaccatacaattgacccaatcgcactttgtagatgaatacgatcccacaattgaggattcatacaggaagcaagtggtgattgatgatgaagtgtctatattggacattttggatactgcagggcaggaagaatactctgctatgagggaacaatacatgcgcaacggcgaaggattcctattggtttactctataacgtccaagtcgtctcttgatgagcttatgacttactatcaacagatattgagagtcaaagataccgactatgttccaattgtggttgttggtaacaaatctgatttagaaaacgaaaaacaggtctcttaccaggacgggttgaacatggcaaagcaaatgaacgctcctttcttggagacatctgctaagcaagcaatcaacgtggaagaggcgttttacactctagcacgtttagttagagacgaaggcggcaagtacaacaagactttgacggaaaatgacaactccaagcaaacttctcaagatacaaaagggagcggtgccaactctgtgcctagaaatagcggtggccacaggaagatgagcaatgctgccaacggtaaaaatgtgaacagtagcacaactgtcgtgaatgccaggaatgcaagcatagagagtaagacagggttggcaggcaaccaggcgacaaatggtaagacacaaactgatcgcaccaatatagacaattccacgggccaagctggtcaggccaacgctcaaagcgctaatacggttaataatcgtgtaaataataatagtaaggccggtcaagtttcaaatgctaaacaggctaggaagcagcaagctgcacccggcggtaacaccagtgaagcctccaagagcggatcgggtggctgttgtattataagttaa

SEQ ID NO: 67 - protein, 570 aa, Bacillus subtilis
MTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 68 - protein, 343 aa, Anaerostipes caccae
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 69 - protein, 343 aa, Anaerostipes caccae
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 70 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 71 - protein, 571 aa, Streptococcus mutans DHAD
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 72 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

SEQ ID NO: 73 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 74 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 75 - protein, 347 aa, Beijerickia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 76 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 77 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 78 - DNA, 32 bp, Artificial Sequence
  Primer oBP622
aattggtaccccaaaaggaatattgggtcaga

SEQ ID NO: 79 - DNA, 49 bp, Artificial sequence
  Primer oBP623
ccattgtttaaacggcgcgccggatcctttgcgaaaccctatgctctgt

SEQ ID NO: 80 - DNA, 49 bp, Primer oBP624
gcaaaggatccggcgcgccgtttaaacaatggaaggtcgggatgagcat

SEQ ID NO: 81 - DNA, 34 bp, Artificial sequence
  Primer oBP625
aattggccggcctacgtaacattctgtcaaccaa

SEQ ID NO: 82 - DNA, 34 bp, Artificial sequence
  Primer oBP626
aattgcggccgcttcatatatgacgtaataaaat

SEQ ID NO: 83 - DNA, 34 bp, Artificial sequence
  Primer oBP627
aattttaattaattttttttcttggaatcagtac

SEQ ID NO: 84 - DNA, 40 bp, Artificial sequence
  Primer HY21
ttaaggcgcgcctatttgtaatacgtatacgaattccttc

SEQ ID NO: 85 - DNA, 56 bp, Artificial sequence
  Primer HY24
acttaataactttaccggctgttgacattttgttcttcttgttattgtattgtgtt

SEQ ID NO: 86 - DNA, 56 bp, Artificial sequence
  Primer HY25
aacacaatacaataacaagaagaacaaaatgtcaacagccggtaaagttattaagt

SEQ ID NO: 87 - DNA, 40 bp, Artificial sequence
  Primer HY4
ggaagtttaaacaccacaggtgttgtcctctgaggacata

SEQ ID NO: 88 - DNA, 30 bp, Artificial sequence
  Primer URA3-end F
gcatatttgagaagatgcggccagcaaaac

SEQ ID NO: 89 - DNA, 22 bp, Artificial sequence
  Primer oBP636
catttttttccctctaagaagc

SEQ ID NO: 90 - DNA, 22 bp, Artificial sequence
  Primer oBP637
tttttgcacagttaaactaccc

SEQ ID NO: 91 - DNA, 40 bp, Artificial sequence
  Primer oBP691
aattggatccgcgatcgcgacgttctctccgttgttcaaa

SEQ ID NO: 92 - DNA, 41 bp, Artificial sequence
  Primer oBP692
aattggcgcgccatttaaatatatatgtatatatataacac

SEQ ID NO: 93 - DNA, 34 bp, Artificial sequence
  Primer oBP693
aattgtttaaacaaaggatgatattgttctatta

SEQ ID NO: 94 - DNA, 33 bp, Artificial sequence
  Primer oBP694
aattggccggccgcaacgacgacaatgccaaac

SEQ ID NO: 95 - DNA, 34 bp, Artificial sequence
  Primer oBP695
aattgcggccgcatgacaggtgaaagaattgaaa

SEQ ID NO: 96 - DNA, 34 bp, Artificial sequence
  Primer oBP696
aattttaattaaacgggcatcttatagtgtcgtt

SEQ ID NO: 97 - DNA, 40 bp, Artificial sequence
  Primer HY16
ttaaggcgcgccccgcacgccgaaatgcatgcaagtaacc

SEQ ID NO: 98 - DNA, 56 bp, Artificial sequence
  Primer HY19
acttaataactttaccggctgttgacattttgattgatttgactgtgttattttgc

SEQ ID NO: 99 - DNA, 56 bp, Artificial sequence
  Primer HY20
gcaaaataacacagtcaaatcaatcaaaatgtcaacagccggtaaagttattaagt

SEQ ID NO: 100 - DNA, 22 bp, Artificial sequence
  Primer oBP730
ttgctccaaagagatgtcttta

SEQ ID NO: 101 - DNA, 22 bp, Artificial sequence
  Primer oBP731
tgttcccacaatctattaccta

SEQ ID NO: 102 - DNA, 34 bp, Artificial sequence
  Primer HY31
gccgactttatggcgaagaagtttgctcttgatc

SEQ ID NO: 103 - DNA, 34 bp, Artificial Sequence
  oBP562
aattgtttaaacatgtatacagtaggtgactatc

SEQ ID NO: 104 - DNA, 49 bp, Artificial Sequence
  oBP563
aatcataaatcataagaaattcgcttatcagctcttgttttgttctgca

SEQ ID NO: 105 - DNA, 49 bp, Artificial Sequence
  oBP564
ttatttgcagaacaaaacaagagctgataagcgaatttcttatgattta

SEQ ID NO: 106 - DNA, 34 bp, Artificial Sequence
  oBP565
aattggccggccaaaaaaagcatgcacgtataca

SEQ ID NO: 107 - DNA, 32 bp, Artificial Sequence
  oBP505
aattgagctcactgtagccctagacttgatag

SEQ ID NO: 108 - DNA, 35 bp, Artificial Sequence
  oBP506
aattggcgcgcctgtatatgagatagttgattgta

SEQ ID NO: 109 - DNA, 35 bp, Artificial Sequence
  oBP507
aattttaattaagtctaggttctttggctgttcaa

SEQ ID NO: 110 - DNA, 33 bp, Artificial Sequence
  oBP508
aattgtcgactttagaagtgtcaacaacgtatc

SEQ ID NO: 111 - DNA, 34 bp, Artificial Sequence
  oBP674
aattggcgcgccaattaccgtcgctcgtgatttg

SEQ ID NO: 112 - DNA, 34 bp, Artificial Sequence
  oBP675
aattgtttaaacttgaatatgtattacttggtta

SEQ ID NO: 113 - DNA, 36 bp, Artificial Sequence
  oBP821
aattgtttaaactaagcgaatttcttatgatttatg

SEQ ID NO: 114 - DNA, 34 bp, Artificial Sequence; identical to SEQ ID NO: 106
  oBP484

SEQ ID NO: 115 - DNA, 37 bp, Artificial Sequence
  oBP822
aattgcggccgcgtgcctcatctatatttctgaaatc

SEQ ID NO: 116 - DNA, 37 bp, Artificial Sequence
  oBP823
aattttaattaatcagctcttgttttgttctgcaaat

SEQ ID NO: 117 - DNA, 36 bp, Artificial Sequence
  oBP828
aattgtttaaacatgtataccgtaggacagtacttg

SEQ ID NO: 118 - DNA, 35 bp, Artificial Sequence
  oBP829
aattgtttaaacttaagagttttgcttagataagg

SEQ ID NO: 119 - DNA, 3930 bp, Artificial Sequence
  pUC19-URA3MCS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 120 - DNA, 12896 bp, Artificial Sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 121 - DNA, 12497 bp, Artificial Sequence
  pYZ107F-OLE1p
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgctttgttgtaatgttttagtgctgtttataatatgatcaccacaactatctattactatgatgttctattctacgtaatacaaaatataaacggaaacagaagtaggaaagatggaaatagaacaataaatgaatcaagatctgcccccatatatatatgtatatgctgatttgcaagactcgatgagccaggagccgatgatttgctgcatatattgttaactactattatttccacctttgtgtgccatccccatagccgtaacaatagggataggtgtgtctgagtgagcaagactcgtagaagcacacctggttgggcactagataaggtttgttgagtgttcaacgtccgaaagaaagctgccgactatgcgaagagaaccttaagccgttattacctctgcctgtcacaggcgatgtgatgctaacgaacagcaccagagccaagccaactggggcggtctgcagagaaggctgggatacccgaaatagctcgctcaacagctttttttcttctacggaagcccaccagataagcgcctttgttgggcccgctaaccccgggacatgcccgggctcggagttagtttttgcacggccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 122 - DNA, 1647 bp, Artificial Sequence
  kivD_Lg(y)
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 123 - DNA, 1644 bp, Artificial Sequence
  kivD_Ll(y)
atgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagc

SEQ ID NO: 124 - DNA, 15539 bp, Artificial Sequence
  pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 125 - DNA, 725 bp, Artificial Sequence
  UAS(PGK1)-PFBA1
aattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 126 - DNA, 29 bp, Artificial Sequence
  FBAp-F
ctacaatcaacagatcgcttcaattacgc

SEQ ID NO: 127 - DNA, 60 bp, Artificial Sequence
  oBP830
tatttaataataaaaatcataaatcataagaaattcgcttaagagttttgcttagataag

SEQ ID NO: 128 - DNA, 642 bp, Artificial Sequence
  Wild-type codon optimized CYR1 nucleotides 5440-6081
gccatgtcttccgatttctactccgaattcaacaagattatgaagtaccacgaaagagttgttaagggtaaagaatctttgaaggaagtctacggtgaagaaatcatcggtgaagttttggaaagagaaatcgctatgttggaatctattggttgggctttcttcgacttcggtgaacacaagttgatgggtttggaaactaaggaactagtcactattgcctaccctaagatcttagcttctagacacgaattcgcttccgaagacgaacaatctaagttgattaacgaaactatgctattcagattgagagtcatttccaatagattggaatccatcatgtctgctttgtccggtggtttcatcgaattggattctcgtactgaaggttcctacattaagttcaacccaaaggtcgaaaacggtatcatgcaatctatctccgaaaaggatgccttgttgttcttcgaccacgttattaccagaattgaatcctctgtcgccttgttgcacttaagacaacaaagatgttccggtttggaaatctgtagaaacgataagacctccgccagatccaacatcttcaatgttgtcgacgaactattacaaatggtcaagaacgctaaggacttgtccacttga

SEQ ID NO: 129 - DNA, 6081 bp, Artificial Sequence
  CEN.PK 113-7D wild-type CYR1 with native nucleotides from 5440-6081
  misc_feature (2569)..(2569): n is a, c, g, or t
atgtcatcaaaacctgatactggttcggaaatttctggccctcagcgacaggaagaacaagaacaacagatagagcagagctcacctacggaagcaaacgatagaagcattcatgatgaggtaccaaaagtcaagaagcgtcacgaacaaaatagtggtcacaaatcaagaaggaatagcgcatatagttattacagcccacggtcgctttctatgaccaaaagcagggagagtatcactccaaatggtatggatgatgtaagtatttcgaacgtggaacatccaaggccgacagaaccgaaaatcaaaaggggtccatatttactgaagaaaacattgagcagtctttcaatgacgagcgcgaatagtactcatgatgataataaagaccacggttacgctttgaattcatccaagacgcacaactacacatctactcataaccatcatgacggtcatcatgatcatcatcatgttcagttttttcccaataggaagccatcattagcggaaaccctattcaaaaggttttcagggtcaaacagtcacgatggcaataagtcaggaaaggaaagtaaagttgctaacctttccctttcaacggtaaatcctgcacctgctaataggaaaccttctaaagactccactttatctaatcacttggctgataacgtgccaagcactttacgaaggaaagtgtcctcattggtacgtggttcttccgtccatgatataaataatggtattgcagataaacagattagaccaaaggctgttgcgcaatcagaaaatacattacattcatccgatgttcccaatagcaaacgctcgcacagaaaaagctttctgctaggctccacatcttcttcaagcagtagaagaggttcaaatgtcagttcaatgactaacagtgacagtgcaagtatggcgacgtcgggtagtcatgttctccaacataacgtatctaatgtttctccaactactaaaagtaaggacagcgttaacagcgaatccgccgatcacactaataataaatccgagaaagtgactccagaatataatgagaacattccggaaaattctaactctgacaacaaacgcgaagccacaacgcctactatagaaacacccatttcatgtaaaccatcccttttcaggctagatacaaaccttgaggatgttactgatattacaaagacggtgccacccaccgctgtcaattctacactaaattctacacacgggactgagactgcctcacccaaaacggtgatcatgcctgaaggtcctaggaagtcggtgtcaatggctgatctctccgtcgctgccgcagcacctaatggtgaattcacatcaacttccaatgatagatcacaatgggtagcacctcaaagctgggatgtggaaaccaaaaggaaaaaaacaaaacctaaagggagatcgaaatcaagaaggtcaagtatagatgctgatgaacttgatcccatgtcaccggggccaccttcaaaaaaagactctcgtcatcatcacgatcgaaaggataacgaatcaatggtcactgcgggtgacagtaactcaagttttgttgatatatgtaaagaaaacgttccgaatgatagcaagaccgcactcgatactaaatctgtgaaccgcttaaaaagtaatttggctatgagtcccccaagtatacgatatgctccatcaaatttagatggggactacgacacgtcttccacttcctcatctttaccgtcctcatctattagttcagaagatacatcttcctgcagcgattcctcttcgtacactaacgcgtatatggaggccaaccgagagcaggataataaaacaccgatcctgaataaaacgaaatcgtataccaagaaatttacatcctcttcggtaaatatgaattcaccagatggtgcccagagttctggattattactacaagatgagaaggacgatgaggtcgagtgccaactggaacattactataaagatttcagtgatttagatccaaagaggcactatgctattcgtatattcaatactgatgacacttttacgactctctcatgtactccagcgactaccgtcgaagagataatacctgcacttaaaagaaaatttaacattacagcgcaagggaattttcaaatttccctgaaggtgggaaagttgtcaaaaattttgagaccaacttcgaaacctattttaattgaaagaaaacttttacttttgaatggttatcgaaagtcagacccacttcatattatgggtatagaggatttaagttttgtttttaagtttcttttccatcctgtcacaccttctcactttactcctgaacaagaacaaagaataatgagaagcgaatttgttcacgtagatttaaggaatatggatctgactacacctcccatcattttttaccagcatacgtcagaaatagaaagtttagacgtttctaataacgcaaatatattcctacctctggagttcattgaaagctcgattaaattattaagtttgagaatggttaatattagagcatctaaatttcctnccaatatcactaaggcgtataaactagtatctttggaattacagagaaacttcataagaaaagtaccgaactcaatcatgaaactgagtaatttaacgatattaaaccttcaatgtaatgagcttgaaagcctaccggctggatttgttgaactgaaaaatctgcaattgctagacttgtcttcaaacaagttcatgcactacccagaagttattaactactgcaccaatcttttacaaatagacctatcatataataaaatccaaagcttaccacagtccactaagtacctagtaaagcttgcgaagatgaacctttctcataacaaactaaattttataggcgacttatcggaaatgacagatttgaggacgctgaacctaagatataacagaatatcatcaattaagacaaatgcgtctaacttgcagaacctttttttaacagataatagaatttcgaactttgaagacactttgccgaaactaagagcccttgaaattcaagagaatccaatcacttctatatccttcaaagatttttatccaaaaaacatgacaagtttgacgttgaacaaggcacagttatcgagtattcctggagaattactcaccaaactatctttcctcgagaaacttgaacttaatcagaataatttgactagactgccacaggagatatccaagttgactaaattagttttcctttcagtggcgagaaacaaactagagtatattccacccgagctatctcaactgaaaagtttgaggacattagatctacattctaacaacataagggactttgttgacggtatggaaaaccttgaactaacatcgctaaatatttcatcgaatgcattcggtaactctagcttagaaaattctttttaccataacatgtcatatgggtcaaagttatctaaaagcctgatgttttttattgctgcagacaatcaatttgatgatgctatgtggcctcttttcaattgctttgtcaatctgaaagtgctaaatctttcttacaacaatttttcagatgtatcgcacatgaaacttgagagcattaccgaattgtacctctccggtaataagctcacgacattgtcgggtgatacagttttgaaatggagctctttaaagactttaatgttgaatagtaaccaaatgttatctctgcctgcagaattatcaaatctctcacagctaagtgtatttgatgttggagcaaatcaattaaagtataatatatcaaactatcattacgattggaactggaggaataataaagaactaaaatatttgaatttttcaggaaatcgaaggtttgaaataaagtcatttataagtcacgatattgatgctgatttgtcagatctgacagtattacctcagttaaaggtactaggtttaatggacgtaactttaaatactaccaaagtaccggatgaaaatgtcaatttccgtttaaggacaactgcatcaataataaatgggatgcgctacggtgttgctgatacattaggtcaaagagactatgtgtcatctcgtgatgttacctttgaaagattccgcggaaatgacgacgaatgcttactatgtcttcatgatagtaaaaaccaaaatgcagattatggccacaatatatcaagaattgttagagatatttacgataaaatactgatcagacaactggaaaggtatggagacgaaacagatgataatataaaaactgcacttcgtttcagttttttgcaactgaataaggagattaacggaatgctaaattctgttgataatggtgccgatgttgccaatctttcatatgcagacttgctaagtggcgcttgctctactgtgatatatatcagagggaagaaactcttcgctgcaaatttaggtgactgtatggctattttatccaaaaacaatggtgactaccaaacgctaaccaaacaacatctcccaacaaagcgggaagaatacgagaggatcagaatatctggcgggtatgtcaacaatggaaaattagatggtgttgtagatgtgtctagagcagtgggtttttttgatttgcttccccacattcatgcttctcccgacatatctgtcgtgacattaacaaaagcagacgagatgcttattgtagcaacgcataagttatgggaatacatggacgtggatacagtttgtgatatcgcgcgtgagaatagtactgatccactccgtgccgcagctgagttgaaggatcatgccatggcttacggctgtacagagaatattacaattttgtgccttgctctttacgagaacattcagcaacaaaatcggttcactttaaataaaaactctttaatgactagaagaagtactttcgaggatactacattaagaagacttcaacctgagatttctccgccaacaggtaacctagcaatggtcttcactgatatcaaaagctcaaccttcttatgggagctattccctaacgcaatgaggaccgcaataaaaactcacaatgacattatgcgtcgtcaactacgaatttacggtggttacgaagtaaagacagaaggagacgcctttatggtggcatttcctacgccaactagtggtctgacatggtgcttaagtgttcaattaaaactcttggatgcacaatggccggaggaaattacctcagttcaagacggctgccaagttacggatagaaatggtaacattatctatcaaggcctatcagttagaatgggtattcattggggctgcccagttccagagcttgatttagtgactcaaagaatggactatttggggccgatggtcaataaggcagcaagggtccagggcgtcgctgacggtggtcagattgcaatgagtagtgatttttactctgaattcaacaagataatgaagtatcatgagcgagtagtgaagggcaaggaatctctcaaggaagtttatggtgaagaaattatcggagaggttcttgaaagagaaattgccatgctggaaagtattggttgggcattttttgactttggcgagcataagctaatgggactcgaaaccaaagaactcgttactattgcgtatcctaagattcttgcttccagacacgaatttgcatctgaagatgagcagtcaaaattaatcaatgaaacgatgttgtttcgtttaagagtcatttcaaacagactggaatctataatgtcagctttaagcggcggatttattgaactagactctcggacggagggaagttatattaaatttaaccctaaagttgaaaatggtattatgcaatcgatttctgagaaggatgcgttgttattttttgatcatgtaattactagaatcgaatccagtgtggcattattacatttacgacaacagaggtgttcaggactggaaatttgcagaaacgataaaacatctgctcgaagcaatattttcaatgttgttgacgaacttttacaaatggttaagaacgcaaaggatttatcaacttga

SEQ ID NO: 130 - DNA, 500 bp, Artificial Sequence
  500 bp sequence from CEN.PK 113-7D immediately downstream of the CYR1 gene
gttctgttcgtaaattatgtaccaccctgttactcgtttcatattcacgctagagaagtacctcagcttactagatccattcacacattgcaagtatactaaaactatataaaatttaagtacgtaaactctttacttattattatcttcaatgtcatcacgtacttaattatgttaaatatagattgtgtataaataagaaataggatctgttttgaaaaattggccaaaaaggcagatttattaagcctatagagataaggttcttgccatttttcatacatttactgttttctcttgaatgactataatattgccaaaattgcctcgaatatgttgtttcatctcctctcatatttggctttctaagtcttttagttgtattggtgattgctccaattctgaatgattactatgctgctgactaggcgtaaccaatccaacttctccttcattaggatcaaccaagccctcaaaaaaggtgtctctaagctctctcc

SEQ ID NO: 131 - protein, 1974 aa, Chaetomium globosum CBS 148.51
MRDHSISDLLDYRRDLAILDPAGGRSSRNQHNNPSTGSLGQIAPWMTGNGSAASPAAPPDPAPATFYNDSTDNLSLDSRLSPGVRTSISQRDPCRHRLPRRSILYRREAPDIARYGEAPVRDILSGPDRGRYMTDGSAQIPPKTSGSGRSGHSIVHLPGHHRHNKSNEDPRSLRPSISREDSSAPAPKERNGSNGMYGTRSRAQSPAPSANSGSWGSKTVVNDGQTSPGHHHHKRRFIDRLVGRRDKDDRQADLRKLPVSSQSLQPRPSKYEFPFSEGQSTHGSEWPATPDLRDVHGSRPGYVRTATFQNKFPFSSSKKSRTIRQHDDIDENIGPTDKQVSGGTVFHLDTNLSDMEGILSRPLPLTPMDPDFLNDIDFDKLPIQPTDPSGAWNAPDSWAVRRGDDTSAQVPEADDIGSPPRPEEKLTNYCIRVFRPDGTFATLQMALDATVSEVVSQLVKKSYVMDGVKDYSIVLKKHNLTRVLGSAERPLLMQKRLLQQVGYEERDRIEDIGREDNSYLCRFMFLPAQANDFHAAANNSGLSRPVKYSHVDISGRNLIAIPLVLYSKASEIISLNLSKNLSLDVPRDFIQACTSLRDIKYLSNEARKLPPSLASANKLTFLDVSHNRLEELEHADLGGITGLLKLKLANNRLNHLPTYFGAYSVLRALDLSSNYLEKFPAFLCGLESLVDLDLSFNLISDLPDAIGKLRSLEKFVVTNNRLTGTFPRSFKDLSSLRELDIKYNTIVNIDVIAELPKLEILTADHNSVSQFVGTFERLRSLKLNSNPVTKFEIRSPVPTLKLLNLSSAQLASIDESFNNMPSLERLVLDRNYFVSLPSQIGNLRKLEYFSIAHNSVGKLPQEIGCLTELRVLDVRGNNIRRLPTELWWASKLETLNASSNILDSFPTHASRAPQPPEDPNSTTSSLSSKVSGTARGLSPMPSVEELKGDASRRPSQASSATLLSVGPSPVPGADNRKGSMVSLYGKGGRNTSVVSRSTPSGSIATISPALRKDSGFGAILTNTFAGSLRELYLADNQLDDDIFDQTTLLSELRILNLSYNELGDMPQRIMKNWPQLTELYLSGNELASLPADDLEDYSLLQTLHINGNKFTNLPADISRAKRLAVLDCGSNSLKYNIANVPYDWNWNLNPKLRYLNLSGNRRLEIKQAYPGASAQNREQLTDFGRLANLRVLGLIDVTLTQPSIPDQSEDRRVRTSSSLAGYLPYGMADTLGRNEHLSTIDLVVPRFNSSDSQTLLGLFDGQALSSGGSKIAKYLHENFNDIFTHELRNLKPSQGETAEDALRRAFLSLNKELVTAAIQHTEDRPITTHRGSQTPLVLSQEDLNSGGVATVVYLDEQELYVANVGDAQAMLIQTDGKAKILTKKHDPADPVERSRIRDAGGWVSRRGRLNDLLAVSRAFGYAKLLPTVQAAPHIKHHTIGDQDDMILVATGELWEYLTPELVVDVARSVRGDLMRAAQKIRDLAIAYGCREKIMVMMLSVSNLKQRRERSRMHRGQSMSWFNFPQDDTNAAAAAARRARKAKATGPLDSVLSRLDAEVPAPTGMIAIVFTDIKNSTQLWETYPGAMRSAIRLHNEALRRQLRIIGGFEVKTEGDAFMVSFPTATSALLWCFAVQTQLLTINWPIEMLSSINCQPAFDRDNKLIFRGLSVRMGIHWGEPLAEPDAVTRRMDYYGPMVNKASRVTACADGGQITASADFLSEIQRCLETYKEPATPNEDSFDEDMFAQAIRNELRTLTSQGFEVKEMGEKKLKGLENPEYIYSLYPHSLVGRVEQHSLHDRAQSTTDKPAVLSPDSDLAVNPDEVWAMWHVALRLEMLCSTLEDVNRRVLQPPETELMERMKQRGGEVTERFLMNFMEHQVSRIETCVSTLAVRKLVLTHEDPTNPNPTNQISDLRAPMSEVLETLTQRLALLQRYEARYGPLGDAGGIPASASALTLHDDLPSDIPVGLGRRVRA

SEQ ID NO: 132 - protein, 1839 aa, Lachancea kluyveri
MSSPTDAERVNMRREKHPQIEETFEEHVHNAMPKFKKHYALGITTHTNDEDDDPRDHRQRGIHNPNFIHSPNDPRPPLSQPIKPRFSVHGTASNASVFSHGDIAPVRKTSRAGSLFKRLAGKKSTTSLLGTEHQQRQQQQSSNSLVPAAGLRRKMSTFIHGGSGSQSNESRGTRSSIFFPSTSNSRRGSATSTMTSGSRSSHPPDTPPITSQQQEQQYDQQRQQRPETREQEQKPPTLSDMPIVSRSPSFFMLDTDLNNLSDITNIISATPKNTESDEVRSTGANKTLKYPKPPLSSHKSTSASDLSHHKAQWTAPESWDIEEDANKLLATKRKAKHHHHYHHPQHPRPPHRKHYSNFSKPIEDKAVVEKEQEPPEKCPQPISTDSNDAQGLEIAKPIDESSGIQHSASTQSVSSFSSGATGASGATGKQIGGDQETESTISTVGEDEEVTNLRSIDSEQTDDTSFSKFDEEYDKAEYQLEKYYNDFSDVDLNRRYAIRIFNIDDTFTTLSCTPNTTLQDMMPQLKRKFNVGQGSYQVSLKVGKLSKILRPTAKPILIQRRLLLLNGYLKSDPLHIMGIEDLSFIFSFVFHPVATSHLNYEQEQRLSRGDFVHVDLRNMDLTTPPIILYQHTSDIESLDVSNNANIFLPLDFIESAIKLSSLRMVNIRASKFPANVTDAYKLVSLDLERNFIKKVPDSIFKLNNLTIVNLQCNNLERLPPGFSKLKNLQLLDISSNKFVNYPEVINSCTNLLQIDLSYNKIHSLPVSINQLVKLAKMNLFNNRLTSVGDLSQMKNLRTLNLRCNRVTSIECHAPNLQNLFLTDNRISTFDDDLTRLRTLELQQNPITSMVCGGNYMANMTSLSLNKAKLSSFSAELLSKLPRLEKLELNENNLTQLPPEINKLTRLIYLSVARNKLESIPDEISDLRSLKSLDLHSNNLRMLMNNLEDLELTSLNVSSNLLTGFHGSPAKFFASPSPKLAKSLLFLSVADNNLTDSIWPLVNTFQNLKTLNLSYNNFVEISDLKLQNLTELYLSGNNFTSLPGEAVQHLRSLKVLMLNGNKLLSLPAELSQLSRLSVLDVGSNQLKYNISNYHYDWNWRNNKDLKYLNFSGNKRFEIKSALDPEGKNDLSDLGILKQLRVLGLMDVTLKTSKVPDESVSIRLRTTASMINGMRYGVADTLGQSDSVCSRDVTFERFRGREDECLICLYDGKNENASSGHKISKIIRDIYDKILIRLLEKYGEESDGIKRALRYSFLQLNKEINGMLVSVEDGNTDSGLTSADLLSGSSATVVYLKGKKIYTANIGDTMAVLSKNNGDFVTLTKLHVPAEREEYERIRTSGGYVNNQKLDGVSEVSRAVGFFDLLPHIHASPDISETVLSYSDEMLIIATHKLWEYLDYETVCDISRENKSQPMSAAEKMKDYAISYGCSDNITILCVSLDKSVNQQSQFTLNREDLISRKNTFEDTVLRRLQPEIAPPTGNVAIVFTDIKNSTFLWELFPDAMRAAIKTHNDIMRRQLRIYGGYEVKTEGDAFMVAFPTPTSALVWCLSVQLKLLEAEWPEEITSIQDGCLITDNSGTKVYLGLSVRMGVHWGCPVPEIDLVTQRMDYLGPVVNKAARVSGVADGGQITLSSDFCSEFKKIMKFHKRVVENQEPLKEVYGEDFIGEVLEREIHMLENVGWVFKDLGEQKLKGLETKEFITIAYPKTLASRHDLATKNQNSSVLNDDLLFQLRTISNKLENILSSINGGLIESETPGNSSIYMTFDKNTKDAVITKSTESDWISFLDHLVTRVESTVAILQLRQKLQGGLELYTSSDSTMHKSVFELLDEILKIQTDQKQ

SEQ ID NO: 133 - protein, 2161 aa, Neosartorya fischeri NRRL 181
MSLRGSENSHRRRSSESSGAHSWLSQETVRESQNPRPLYNTAMPNGRNNSPFPGSAGLERSASQGHNQPKQGSSNNLYSSTFSWNSPDISPTDQRRGVGSHRKGTATSGADDPGPPPTSSSSSKPSQLNPNQIDYFHQNPNASWSTSPKIAPMDSSGTFFHDFSEHEASPASATFRPSTGRTFASDPVDFDYNGDDRRPSVASATTISSQGSKSSTGGRFRKKLQGFFGDEYLPSGESKQEQEQDTRSLSSRPGSIDQFKARERANSDGARNFPERSQDDTSSLHPSRPRTPLPSSDITPWLYQSFNDIPQFGEAPVREAPIAPEGRRLAGQTATNSGTSREARRHHGSHRHSRSKEEKPTVAGDLAGYPARPATGRDDSYLGLRPFRDHSLNASTAMSSTTTLGGRSTSPTPSIQSAYSREQSQNSPGAPSNKRSILDKIRRTKAHGPLKHFPGSKSAQDASKSSSKLARRETSPRRGRQGSLEGGTSIRNLDLGDYERRKDGKGLVMGSTKLRNRRGLGNEALPGKDVKLSEEPGVWRLDTDLSHMEGIVSQQPLPSPSDKSKAQDGVPPQHEEGKKSEGLPPGHWDAPESWQVKKHGEDLAARLPNVASDATGIAREPDGTSYFIRVFRIDSTFATLSAGLNATVADILLMLGRKSFLQDHLNNYEIVMKRNDLSRQLDHSERPILMQKRLLEQVGYTAKDRIEEIGREDHSYICRFIFLPTKLSGYSSLDGDPGFSRMQKFSHVDLQGRSLVTIPITLYKKASEIISLNLSRNLSLDVPKDFIQGCINLREIKFIGNEARRLPASFSLASRLTYLDVSNNLLEELGHANLDRLHGLVSIKMANNKLSELPSYFGNFQYLRSLNISSNNFQVFPSFLCNLKSLVDLDISFNNIAELPNIGKLATLERIWMTNNMLSGPLDETFKDLVNLREIDARFNAITNIDILAQLPRLEQLLIGHNAVSKFKGSFPRLRTLLLDHCPMTQFDIDAPVPTLTSLNIASAKLVQFRDSLFENLPNLTKLILDKNHFVSMSPHIGKLRRLEHFSMIKNPLAALPATIGCLTELKYLNLRECNLRRLPAEIWHCVRLETLNVSSNVLDSFPKHGSSPPQPPSDTGITPAATPGGATTPSYEDLGPLQEQDGLETRRPSQTSGGLFSSGGSPNGGTYRKPSVASSLGQSGRKVSAASRSGTEGSPSSRKDSNFSQHVATTFAGSLRNLYLADNRLEDDIFRELSLIPELRVVNLSYNELTELPQGLLKRWPFLTELYLSGNELTSLPSDDLEEGSNLKVLNLNANRFQVLPAELCKVSKLAILDVGSNALKYNVSNWPYDWNWNWNRNLKYLNFSGNKRLEIKPNITSAGPTTANGTDLTDFNSLTHLRVLGLMDVTLTTPTIPEENEDRRVRTSASLAGSLAYGMADFLGKSEHLSIIDMIVPRLKPDNVETLVGLFDGQAQSTGGSRIAKFLHENFTSTFSSELKKLRVEEEETPLDALRRTFLALNKNMAAAAYKSIDDRSVRQFHRGSPATKLLNQDDIRSGGIATVLYLNNMDLYVANVGDAQAILVKSDGTLKYLTKNHDPAEPHERARIRAAGGFVSRNGRLNDILHVSRAFGHFQLMPAVVAAPHTMHVHLTEQDEMIILASKELWDYVTPDVVVDVTRAERRDLMIAAQKIRDLAISFGANNKLMVMILGVSDLKKREKFKFRGTSLSMGPPAFPEEQIIPSTKRTKKPRDMPGDSRLARFDYVDAPIGELAIIFTDIKKSTSLWETCPDAMRSAIQIHNDILRRQLGIIGGYEVKTEGDAFMVAFSTTTAALLWCFNCQTQLLEAEWPTEILEQPQCQVQYDMENNIIFRGLSVRMGIHWGEPVCEKDPVTNRMDYFGPMVNRASRISAVADGGQIFVSSDFMSDIQRNLEVYADSERAASTGSEESYAVDSLGYNIRRELQQLNSQGFVIKDQGERKLKGLENPEPLYLIYPHSLSGRLTTLEQAEARENGPTTISKHSELEIQTDLIWRLWELTLRLERLCGALENPGEARLKEPNVALFNLVKNHGGELADSTVVSLVEQQVTRIEMNITTLSVRYMLKPFKPGDKLSDHAVPIGEVMQQLQTQLAEYRALKEQLAVGAAGITGAPSSSPGAEGQDTGESDSSSASSSFLQLATSSE

SEQ ID NO: 134 - protein, 2155 aa, Blumeria graminis
MTRKDLATRNSSATSSAPDGGRTRDILNLSASWTICPIQQGTRVCVNTNQNKLLATKTQVYCKEHQPVFSPTTFNAYLREREHCSSVLGNCSRNFAALETGKKECLPPNQHNISTPTAASLHHFEATWMASTRGPLTLPGSASFGTSFFSDANDQKPENSPLSPGPRLSTGLSTTSTVGDLTGETYFGEERRPSIASVHTASSQSSISSVSRPGIHKKLQTFFGDDFPGRNRADSSLPSQRNQGRSQSFVRKQRDRATSSGAETTRKREASPADSRPRTPVPSRDVVPFLYQDSQDISKYGEAPVRDKLSGLDRDRYAGDSVITSKLSSSFTGQSHVVSSGRFTKGTEDLRPSHPSLVREEFGSASRSRDRAPKAMGTALGSSSNSGQAKRSVSPTIIAAVIKNSTSNNINSNSNINSGNHDGSTSPTLPSKRGILGRFLKHKEKDSVPLRLKEVPNTSRTFSSPGSRNDTTRGPTSPETAMSSWSREGSITGLDSSSSKAETGRPNNGSYRQGAFSKLQLRKGKPKITDEQDSLAESTENNDIISGLMFSLDTNLNNMEGILAKPPPLTPLDNSLINSLEDEAKDEAENIGSLGWNAPDSWAVKKSNDDTMSRLSDINEAYVPPMEDEKSNPYCIRIFRLDGTFATLSTPLNATVAELMGQLGRKTYMTDSLANYQIVMKKHDLQRILGPGERPVVIQKRLLEQAGYEERDRIEDVGREDNSYLCRFSFIPARESGYASFATDPLAGRVQKYSHIDLSRRNLVTIPIALYSKASEIISLNLSRNLSLDLPKDFIQSCQNLRDIKFTNNEAWKLPLSLSHGTRLSILDVSNNRLEQLERSELDRLQNLASLKLANNRLGSLPSYFGNFKLLRTLNVSSNFLESFPTFLCDLESLVDIDMSFNGISSLPDEIGQLTNLERFIITNNRLNGSLPLTFGDLVNLKEVDIRYNALSSIDVIARLPKVEQISADHNSVSVCESEFTKIRILRLNSNPVTKFEILNSVPTLKTLNLSNAKLAHVPDAIFDRMPNLVKLILDINHFVSLPMHIGKLRKLEHFSIARNALNSLPQEIGCMTELRFLDVRQNNLKKLPIELWYASKLETLNVSSNVLDSFPMPASRPPQIPGEIFPMVPQNTSNGSLGPNSTASSFEEIGALEAFGQRRSSQASYSLLGVGGSPGSGVTERKTSVVSSYSKGGRQTSIVTRTGSEMTAGNITPLRKDSGISTRLISTFSRSLKNLYLADNQLDDDVFDKLILLGELRILNLSYNDLNDIPHRSIKSWPQLSELYLSGNELTSLPSDDFEEFSLLQVLHINGNKFQTLPAELGKAHRLAVLDCGSNSLKYNVSNWPYDWNWNWNTNLKYLNLSGNKRLEIKPSAPGGAGNRDGRDLTNFNALQNLRILGLMDVTLTISSIPDQTEDRRVRTSGSVAGHLSYGMADTLGKNDHLSIIDMVVPRFNSSEAETLMGMFDGQALSGSGSKIARYLHENFGHIFSEELKKLNSELGETPADALRRAFLSLNKDLAIAATQCAEERPLLTHRSTTASTALSHTDLQSGGVATVVFLQNSELYVANVGDAQAMLIHSEGGHRILTRKHDPAEPNERQRIRDAGGWVSRQGKLNDILEVSRAFGYVQIMPAVQAAPHITQVTVKEQDEMILIASRELWEYLSPELVVDVARYERGDLMRASQRLRDLAIAFGATNKLMVMMIGVSDLKKRAQIRPHRVQSLLFNPGTIIDETYAPTRRPRKKGETVEDSGLRRLQAEVDAPVGDVSIAFTDIKSSTLLWETYPSAMRSAIKLHNEVMRRQLRIIGGYEVKTEGDAFMVSFPTATSALLWCFAVQQALLEVQWPSEVLSSVLGQEVYDNDQTLIFKGLSVRMGVHWGHPVCETDPVTRRMDYFGPMVNRAARISAVADGGQITVSADFISEIQRCLETYSESARSDSMGSEEAFESDIYRQAIRRELRSLSSQGFEVKDMGERKLKGLENPEYIYLMYPHALSGRIHYQQRLAEGDKLVAVEGPARFSDTTQLNIDIDSLWGLWHVSLRLEMLCSSLEVENGIGMPLQAPETTILEKIRSRGGEITDRVLINSLAHQVTRIESCISSLVTRHLAVGQCPLYNFDQLRAPMTEVLGSIAVQLRELRILKAGYIDQDFSNLSKRRT

SEQ ID NO: 135 - protein, 2159 aa, Aspergillus clavatus NRRL 1
MSMRDSDQSLGRRSSESSGKNSWLSQETVREGPSQQPLDRQAMPNGRSNSPFPGPVNMERSASQGHRPPNMGSANNLYASNFSWGSPDISPTDQRKGLGNHRKVMALLGNDDPGPPPTSSSNTRSSQPNQPNQIDYFHQDPNASWSSSPQIAPMDAPGTFFHDLSEHEASPASGSFRPGTGRTFASEPVDLDYNGDHRRPSIASATTISSQGSKSSTGGRFRKKLQGFFGDEYLTPADSKQDSEQGAPSLNSRAGSIDQFRARERANSDGARNFPERSNDDASSRHPSRPRTPLPSSEITPWLYQSFNDIPQFGEAPVREAPIASGSHRAAGQSATNAGASRDARRHFTGHRHSRSKEEKPTVAGDLAGYPARPATGRDDSYLGLRPFRENSLNMPTAMSSSTTLGGRSTSPTPSMQSAYSREQGQNSPGAPPNKRSILDKIRRTKAHGPLKHFPGSKIAQEASRSSSKLSRREASPRRGRQGSLEGGASIRNLEIGDPERRKDGKGLAIGSAKLRNRRAVVNEAPPGRDARPSDEQGVWRLDTDLSHMEGIVTQHPPPSPTDMGRPPDGIAVQQEDGKRQEAAPAGHWDAPESWQVKKHGEDLAARLPSTAGDTGLVVPERDGLSYFIRVFRIDSTFATLSAGLNATVADILLMLGRKSFLQDHLNNYEIVMKKHDLSRQLDHSERPILMQKHLLEQVGYTAKDRIEEIGREDHSYICRFIFLPTKLSGYSSLDGDPGFNKMQKFSHVDLQGRSLVTIPITLYKKASEIISLNLSRNLSLDVPKDFIQGCINLREIKFVGNEALRLPASFSLASRLTYLDVSNNLLEDLDHAHLDSLHGLVSIKMANNKLKTLPSYFGNFQYLRNLNISSNSFQTFPSFLCNLKSLVDLDISFNNIAELPNIGKLTTLERLWVTNNVLRGPLDETFKELVSLKEVDARFNAITNIDTLAQLPRLEQLLIGHNAVSKFRGSFVKLRTLFLDHCPMTQFDIDAPMPTLTSLNIASAKLVQFKDSLFEYLPNLSKLVLDKNHFVSMSPHIGKLRRLEHFSMIKNPLAALPATIGCLAELKYLNLRECNLRRLPPEIWHCARLETLNVSSNVLDSFPKHGSPPPQLPSDTGTTPTPTPGGTIVPSFEDLGPLEEQEARRPSQTSGGFFSTGSSPNGGTFRKPSVASSLGQGGRKVSTASRSGTEGSPSSRKDSNFSQHVATTFGGSLRNLYLADNRLEDDIFRELSLIPELRVVNLSYNELAELPQGLLKRWPFLTELYLSGNELTSLPSDDLEEGSNLKILNLNANRFQVLPAELCKVSKLAILDVGSNSLKYNVSNWPYDWNWNWNRNLKYLNFSGNKRLEIKPNITSMGPSATNGADLTDFNSLTHLRVLGLMDVTLTTPTIPEENEDRRVRTSASLAGSLAYGMADFLGRSEHLSIIDMIVPRLKPDNVETLVGLFDGQAQSTGGSRIAKFLHENFTSTFSSELKRLRLDEQETPLDALRRTFLVLNKNMAAAAYRSIDDRSVRQFHRGSPATKLLNQDDIRSGGVATVLYLNNMDLYVANVGDAQAILVKSDGSLRHLTKNHDPAEPHERARIRAAGGFVSRNGRLNDILHVSRAFGHFQLMPAVIAAPHTMHVNLTEQDEMIILASKELWDYVTPDVVVDVTRAERRDLMIAAQKIRDLAISFGANNKLMVMILGVSELKKREKFKFRGTSLSMGPSAFPEGEIIPSTKRTKKPRDAPGDSRLARFDYVDAPIGELAIIFTDIKKSTSLWETCPDAMRSAIQIHNDILRRQLGIIGGYEVKTEGDAFMVAFSTTTAALLWCFNCQTQLLEAEWPTEILEQPQCQVQYDMDNNIIFRGLSVRMGVHWGEPVCEKDPVTNRMDYFGPMVNRASRISAVADGGQIFVSSDFMSDIQRNLEVYADSERAASTGSEESYAVDSLGYNIRRELQQLNSQGFVIKDQGERKLKGLENPEPLYLIYPHSLSGRLTTLEQAESTENGPTTISKHSQLEIQADLIWRLWEITLRLERLCGALENPGDARLTEPNLALFNLVKNQGGELADSTVVSLVEQQVTRIEMAINTLAVRHMMRPFKPGDKLSDHAAPIDEVMQQLQTQLAEYRALKEQLAVSAAGITGTPSTSKGSGAQVTSGSSPSSASSSFLQLAPPSE

SEQ ID NO: 136 - protein, 2272 aa, Cryptococcus neoformans var. neoformans B-3501A
MPMFRRSASSHSTSDAAAPPTLTNVTEGSPVASGTLTRQKRSRSHGGGGSPASTFSSRFGIPRYLPHQHQQSHEQEQGEAPRPDKPATKEIPVSSEPEVYGSEAGEESNFGQEPADEQLVPETGSWSPQSRHSSRKLSVQTVEPSSDDEVRSPEERRVSPLIKRLGEEPPFMLPHPSRADSTYQEYPGVVIGSFAGGGPDTLFGNGMQLEGTMDDILDPNAARQEDRGNQAPAGANIAPWLMDDSPPSPSENPSPASPATQERPVKGPAAALREKDLRKASTVLNHFSSVPSLPKIRRHGRAQTTTPDQTPRGSTHSQSNLASSSSSLNNESRESRAGSDDSIQTTLTQKGRRQSPGEWGQASAVPPPSKGTRPGRFGSTASIISGTGSVGEKKKGLFGGLLKRKTNPNLSLNPISHDFTTSEHRGSAGSIPLSASSSKLSSCSLSSLPTKSPSFTSPPEAFSRQFLPANYVHEGAVSPLQEISESPFHLDMNLDDMEGIIDPTKTGLPSTVAYRPSASSEVTTDSSASESMRLEEALNQTSSFGTSVSGASRGSDGTKMPSRIVLGEAERLPAPFTGMDPFQQHRESASTTGSDGKPFSPPSPHTLSPKHHIPPASANQPRRPSALRNVETGQVDETSQLSASEGSIQPISPSWARDSGMITVFNDPFSTSRQKQEQPPNSASLSHSTTAYPSAVTLPGPSTARFPTTTGSTTPSAAWAAPESWGVEADEAPAEETTSSDEDDWTGAGVDEVASASPTSDTLPSPSTSPRASSLSSPKRAPPFGFKSQQRAKPGTSGTTDSTTTATGRRKGKRVGSSGRPATGRPGTSGSAYSPSSLHWIRIYRADKSYMLYNLPLNTSTGELLALLAAQAEQGMVRGKNVAINMKLYICERGQDRMLLPSEKPLTIQHRRLLQLGHTEADHLDELGKNDMAVLCRFIYQAPILPIMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISNFPESFSTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLITLNLNFNQFTKLPATLDRLTSLEVFSCTDNMLNLVPAGFGKLRRLRVINLHNNNLKSLPEDLWACGALEIFNASSNLLDSFVPPPADIESVVGRVGSGTSQTSNGRKKHSVPPIGLSIRKLFLADNRLNDDIFHWISLMPSLRIINLSFNDIYEVPPFTLCKCERLEALYLSGNKLTSLPSEDLEKLQSLKVLHLNGNKLQTLPSELGAIKTLQHLDVGSNVLKYNIANWPYDWNWNWNTSLRYLNLSGNKRLEIKPTSAHEMNHASSFRKELSDFTALTQLRVLGLMDVTLRIPSLPDESDEKRVRTSFSDINNMAYGISDMLGSIDNLAMFDLVVPHFRGKENECLFGMFGRATTTLQGGKIAKHVQEIFAETLTAHLHKLEPGEEPSEALRRTFLWGDRKAFEFFSGKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMIAAQKLRDFAISYGAEGNVMVMVVNVSDLFLGKGGRARGPSEQTAADASTDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVHDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVCQLSDIALRLEAVCSYNPTPSSPGDTPTAGVMRLHPPASYLGPSIREDMNDEELWTIIESLVGRIENAMSTLYLKNFGEFSTVLAALESATKIDQKLIVHALALMNEAMENAEENAI

SEQ ID NO: 137 - protein, 2153 aa, Hypocrea virens
MAENEAAFRISSGTSASTDSTRSSITAKPSTPTAASSKLLRTTAWAQAQTNMSDAGPCTCRSLSRDDDLQISPTSTGTTRMSPTTSRESGRRLSDLTNYRRDLAVLDPPLRGHPNPANYAASLVDESADNMSIFSQFSSGLHGMGSRTGASSSLGMQDSPEQLFYTDGRRPSAASVTTTASSTGSKASGPRGGFRKLQGFFGEEFPGRDSSESSLPNSYMGKDQRSRSYSHTRPTHRDRNYSNATDHTRDASPASSRPRTPVPAPEVVPFLYQDNTDIARYGEAPVRDIMTGPDRERYMSDGAPQVPPKSSQSSRAGIVHLPGHHHRHNKSIDDPRSLRPSTSREDSTSSSYPRERGGMAGTLFSSSRSRAQSPTPSIGSGQAPYSRSGVLEGHASPGHHGKLGFMGRFRRHKDKDDGNGGGSKLRDLPQSTRSLQAKSSKTDLTRPELSPSAFPSTFVLGSGEVSDASETRSLVAPRATFKNNFPFSKNKRPSRPNDCDEIIGPTDRADPGHMYHLDTNLNDMEGILAKPPPLTPMDTSFVNIDPDPIDSAVSPPVKGGSWDAPDSWAVRRGTEDTTIQQPEPEELSSPPRPEEKLTPYFIRIFRSDGTFSTHSMALDATVAEVISQVIKKTYVVDGLENYHIIMKKHDLIRVLTPGERPLLIQKRLLQQVGYEEKDRIEDLGREDNGYLCRFMFLSARESDFHSKTADLGIKATQKVNYVDLAGRNLVTIPISLYLKANDIISLNLSRNLSLDLPRDFIQSCKNLRDIKFNNNEARKLPLSLGRAARLTYLDASNNRLEQLDNAELNTLSGLLRMNLANNRLTHLPPYFGAYQALRSVNISSNFLDAFPPFLCDLHSLVDLDLSFNSIAELPEEIGQLKSLEKLLITNNHLSGGVPGIVQRALLACAELDIKYNYITNIGRYIRNSQAGDFVCRSQSHLGLCWVNSERIRQLKLNSNPITRFEIQEPLPTLQTLNLSQGQLASIDSAFANMPNLERLVLDKNHFASLPPQIGALSRLEHFSIAHNSVSELPPQIGCLTELRVLDVRDNNISKLPMEIWWAHKLETFNASSNMLENFPKSASRAPRLPGEEPQGPPPTSNGKALPMGTLSATGSSEELAEERRPSQASSTTLLGVGPTPNIPGADRKSSVVSVYGKGGRKTSVMSRGTTQSQNTVSTSNQSLRKDSGLSSRLTNTFAGSLRNLYLADNRLDDDVFDQITLLAELRVLNLSYNWEISDMPQRSMQSWPQLVELYLSGNVLTSLPADDLEESSLLQTLYINGNKFTNLPADISRAKKLAVLDCGNNQLKYNIANVPYDWNWNLNPNLRYLNLSGNKRLEIKQTAWGGIDGPGAVNREEYTDFNRLLNLRILGLMDVTLTQPSIPDQSEDRRVRTSGSLAGHLPYGMADTLGKNEHLSTVDLVVPRFNSSETEMLLGLFDGQALSNSGSKIAKYLHENFGHIFAQELKALKTRQNETPADALRRAFLALNKDLVTTATQYSDDRKKKSHRGVSQPVILSREDLNSGGVATVLYLQGTELYVANVGDVQAMVIKTDSKHHILTRKHDPAEQTERTRIREAGGWVSRNGRLNDVLQVSRAFGYGDLMPAVQAAPYVTSMTIRENDDIIVMATSELWEYLPPGLITDIARAERQDLMRAAQKLRDIAMAYGASGKIMVMMISVVDLKRRVERSRLHRGASMSLYPSGVPAEAPYLLSTRRGRKGKGDVLDSSLNRLEAEIPAPTGNVSIVFTDIKNSTTLWEMYPNAMRSAIKLHNEVMRRQLRRIGGYEVKTEGDAFMVSFPTATSALLWCFAVQMELLDVPWPSEVLNSMSCQPIFDKDNALIFKGLSVRMGIHYGDCVSETAPVTRRMDYFGPMVNKASRISACADGGQITVSSYFISEIQRCLENYQDTDRNTSAGSEASCEDESIATAIRKDLRSLTSQGFEVKEMGEKKLKGLENPEVVYSLYPHALTGRIEYHPQHERQDMGADRPTAVLNGELAFDPDTIWSLWRVSLRLEMLCSTLEEVRGSGASAPWRPELLERMKTRGGEVTERFLINFMEHQVSRIETCVSTLTMRHLAIGGGALRELNQLRAPMAAVFEHFLKQKEELDRYKQKYGPIDDDEPSNGVTIRGDIEDGESGEDAEDSEEDGSDTEQE

SEQ ID NO: 138 - protein, 1475 aa, Meyerozyma guilliermondii ATCC 6260
MVGEDQPIAEEEDDDDVVQEQTTPQSDVAETLSSLPVLYGSHQYSHVVPPQSDPKNLTKGPNHIIRVFKEDNTFTTILCPLETTTTELITIVQRKFFLESVANYQLSVYVGNCVKVLESFEKPLKIQMGLLMLSGYVENDNLRIIGREDLSFICKFVVENINLRNFTHEEEALKSKDYIDVDISGLKLKSIPIKFHQHTYEIEKLNASDNPAIYIPLDFIQSCNNLTSIIFSVNGCSKFPMNFLEATKLTYLDMEKNFLDELPAKFGVLSNLTKLRLNSNQLRSLPKSFGKLVNLKQLNLSSNYFNAYPEPISELVNLQELDLSYNDLSEIPESVSKLVNLVKLNLCTNKLSKALPRHFEALKSLKRLDIRYNMITNVDVIGRLPHLEVAYASKNYVSTFNDKMESLRLLHFDRNPITNLQFEYLLPLLTVLDLSKAKITSIPSDFLTKIPNVEKLVLDKNHLVNLPPQLGSLSKLSHLSLYGNNLQVLPPSIGDLKSLQYLDLHSNTLESLPEEIWNLSSLSVLNISSNALSSFPKPPLSVAKKISSSVDFLNYRAVDQEAESSTEDDSRRPSSLADSLLVLTVADNRLSQDCFDSISFLIELKSLNASYNDLLEIPEGALRRLSKLNDLYLSGNELTNLPADDLEALVHLKLLFLNNNKLASLPAELSNLKQLAHLDVGSNQLKYNISNWPYDWNWHSNTNLKYLNFSGNKRFEIKQSHIKNPETKEDFDSLLVLKKLKVLGLIDVTLTSTSVPDQNIDMRIRTTASELDNIGYGVSDCMGGREHVSTRDIFLQKFRGNENEVLICCFDGKHGKPHVGHRISYLARTTFVPRFTEELNKLKANESVNDAIRRAFLQMNKEINGVLIAKKSNHFTGTPLMNSTFSDLNLNEDGDAGCCMSIIYIKNKKLYTANVGDVETLLTRKNGTHLLLTNKHYPTNRPEFERIRAAGGYVTGDGALDGKLPVSRGIGFFNFLPHTHSGPDIKEIDITTADDMIVLATKILWDYISYELAVDILRQEKEDPMIAAQKLRDYAICYGASDKISVTVITLGEQKPKLKFGSNALYHNLSREGDVFSKRRRDRSQVFGSDSTSRRLEAEIEPPVGEVALVFTDIKSSTLLWDANPVAMRSAIKIHNDKMRRQLRIVGGYEVKTEGDAFMVSFPSPTSALLWCFYVQQQLLDADWPAEILETKQCREVVDAKGHVIFRGLSVRMGVHWGSPVCELDVVTRRMDYFGPMVNRASRISAIADGGQIAMSSDFLRELNTLNKIHDDIAAGRTTISDAYHGNVRAGEIIEREIASLQVTGTAFYELGERRLKGLETPDFVTLAIPKDLEERFTLFQNTLTQEEENKTMGRIVGALPVDAIFGLRTISLKLESICSRLNSQNMVNPEGPETLNNISERFDASEEDVVRLFMHIVTRIEHCVASLQMRQILGGNEGIDFKNPETIFSVIDQLASRLEPNKVGKASGFIEDVS

SEQ ID NO: 139 - protein, 1827 aa, Lodderomyces elongisporus NRRL YB-4239
MSFLKRDKSKSSIYSAGQKYYEEPLSPTAELAANEAFYEPRSVSSSSVNPVTTNGDDKVQDPNDDYHIVNVRLEDGTEYSPRSSIVSFAATPFHNAANNLKDNYKGFHANRRGKSINNVPPLLHPIKPKFKKKSSSLFNKLINSRKDGTEDEDTESPRKERYMSTSSEASMSPPHSNASSRANSITIDDPTLQPLTNLHPHLHLQLYLHLHLQLDQGQGQGQGQEHANQQNQRKSNSSASSSHSRHKVKIPLFGEYHPHHPSTILPYLLQMTQSDYKSQGRKGSGSGSASGSGSEGPSRLPGKLQREPSYTSIPSSTASEKLISLDLNLDEIQDIVKSEDTVAPKQNWKAPDSWDVKAPRIEEEPRILEVDEASSKENENEDEEEDGNENENQDGNGNETGKGGGARSRGGNNSNNYNNNRNGGGSFSKPVIKSLPLLYGAKEATHVVSSIDPSPSHIIRIFKEDGTFTTVLCPLEATTSELLTIVQKKFFLESASNCQLAVHIGNCVKVLESFEKPMKIQMGLLLLSGYTDDDNLRIIGRGDLSYVCRFVVENIYLRNLTHEEEIKLSKNYVDVNISSLNLKNIPIIFHQHTYEIEKLNVSENPSIYIPLDFIQSCTNLTVINSSRNGFSKFPINFLEATHLTELNLEMNFLDDLPSKINALSNLTHLKLNPNQLTLVPKAFGQLSNLVSLNLSSNYFNRYPEPINNLEKLVELDLSYNDLAYIPNSIANLKNLQKLNLCTNKLSKALPDCFKYLQSLKRLDVRYNEITNVDVLGQLSSLEVLYASKNNISGFNDQMENLKLLHFDKNPITELRFVSPLQMLNVLDLSKAKITSISSDFIQMIPNIEKVVLDNNHLVTLPSEIGQLKKLTHLSIFSNNLQTIPNTIGDLVHLQHLDLHSNNIQSLPLEIWSLTSLTMLNVSSNNLTAIPKPPFSIAKRISTPSENPNEMPVSSGSLADSLSVLIAADNRLNDDCFESISYLVKLTSLNLSYNDLIEIPEGSLAPLTQLKDIYLSGNEISTVPDELSQIKALKLLYINNNKLVTLPTKLSELTNLTYFDGGSNQLYYNISNFLYDWNWNFNKKLKYLNLSGNRRFHIKDIKNTQNEEMNGFLGLKELLVLGLIDVTLTTTSLPEQSVDKRVRTTGSEIDTIGYGVSDTIGSRDCISNRDLFIQKFRGNEKELLICSFEGKQGKPGQGHRISSIVKNMIAQNLTDELARVNDEDDKVHIALRRAFLNFNKEINGTLWAKKNNVFTPTAGQSMESCTLNMADDSRAGCAATVIYIRDKKLYSANIGDIEALLCQNNGNFKVLTNSHKPTNRQEFERIRAAGGYVSGSGDLDGTLAISRGAGFFSYLPHTHSGPDVNELTLTPADDLLIIATKTLWEYLTYEFAVDIIRQDKHNPMVAAQKLRDFAISYGASDKITVIVLTFGEKSKESSLYKNVGREAEFFAKRRRDRQIGGDSSLRKLENEIEPPVGELALVFTDIKNSTLLWDTYPASMRSAIKTHNSVMRRQLRIIGGYEVKTEGDAFMVAFPSPTSALLWCFNVQQNLITADWPTEILDTDQCCEVTDGKGNVIYRGLSVRMGIHWGTPVCEPDIVTGRMDYFGPMVNRASRVSAIADGGQIAVSSDFLDEMRALTAIHDDIKSNLKTISDAYHGNVSAGRIIERELTAIEDHGCNFYKIGERKLKGLETPEMITLVYTSRLKLRFEIFQKRLDVDENHSTRVIGTLPVNCITAITDISARLENVLSSLNEGTYIKDGFKGPKVKTQDVSVKDLLNAVTRIENSVATLLLRQKLNGSKPGFSTEPLNHLMTQLVDIIDNVQQESK

SEQ ID NO: 140 - protein, 1749 aa, Scheffersomyces stipitis CBS 6054
MSFLRRDKSKNNLNASAIQNSTAYDIDRPLSPTANLTTNRSPLLRKNTDTYSPRSSIVSLPSEGPPSDVADSGNDSVSSLKDNYRGFHANRRPKAIANIPPLSQPIKPRFKKKSGSLLGKLIYSSRKDSDSSAHSGETTKSEPITEHDRKSASSDTADTVSKHKFRMPSISLEHHHHHHHHPHHPSLEPKESDSDSAKVVGTTFDLDMNLDEMHGIIKSPEDPRNKSSFSDSSTNAAEAIHDGRGNIATQKSHISGPAGPVPESKAVWKAPDSWDVQLDQNMNPIRTIDLALSDSDDTDEKEVNDDIHNHLDVERQEFRRMSDLPVLYGTRQSSHIIQGELDSKTGKPPNHIVRVFREDNTFTTILCSLETTTAELLAIAQRKFFLESISNYQISVYIGNCVKVLEPFEKPLKIQLGLLLLSGYTDNDNLKIIGREDLSYLCKFVVENINLRNLTHEEETMLSRDYVDVNIAGLNLKNIPIIFHQHTYEIEKLNVADNPSIYIPLDFIQSCNNLISINFSKNGCSKFPLNFLEAKKLTHLDMEKNFLDDLPSKFSHLKNLTHLKLNSNQLTTLPKSFSRLKNLEVLNLSSNYFSVYPESISELSNLKDLDMSYNDLASLPESINKLTNLSKLNLCTNKLSKSLPDYFAKMTALKRLDIRYNLLSNVDVLGSLPNLEVAYFSKNNVSAFVDQMENMRLLHFDRNPITSLHFDNMLQYLTIVDLSKAKITSIPDEFITKIPNIEKFVLDKNHLVTLPNELGNLQKLASLSVFGNNLSSLPSTIGKLSSLQILDIHSNNLQSLPDDIWLLKSLSVLNVSSNILSSFPKPPISVAKRVSSTNRLLVLTLADNRLGDDCFESISFLVSLKSLNLSYNDILEIPEGAMRRLTRLTEVYLSGNEIATLPADDLENLKALKLLFVNNNKLVSLPAELSKLTNLQHLDVGSNQLKYNISNWPYDWSWHWNKNLKYLNFSGNKRFEIKSSHVKNQETGEFFDSLLVLKNLKVLGLIDVTLTTTAVPDQSTEMRIRTTSSELDNIGYGVSDSMGLREFVSSRDVFIQKFRGNENEVLICTFDGKRGAPNQGHRVSSLAKNLFVSHFTHELEKVKSDEEINDALRRTFLSLNKEINGILAAKKCNSFAATPQMLKEAVDLNLADDGRAGCSVTVIYIKDKKLYTANCGDTAAILSRNNGDHVLLTNRHDPTSRSEFERIRASGGYVSGDGALDGDLPVARGVGFFNYLPHTHSGPDISSISLTAADDMIVVANKIMWDYISYELAVDILRQEKDDPMLAAQKLRDYAICYGATDKIAVIVITLGEQKSNRSKFGSNGLYNNLGRESDVIAKKRRDRVATTGDSSLRRLDDEIEPPVGELALVFTDIKNSTLLWDAYPVPMRSAIKTHNSIMRRQLRIVGGYEVKTEGDAFMVSFPSPTSALLWCFNVQQNLLTADWPSEILETDQCCEVTDGKGQVIFRGLSVRMGIHWGSPVCETDVVTGRMDYFGPMVNRASRISAVADGGQIAVSSDFLDEFDALHKIHEEISEGKMTLFDAYQGNPRAGEIIEREIASIEDNGYHYFKLGERKLKGLETPEPITLVYTSKLKIRFEIFEKRMSQNQEFNLSTRVVGALPVDSIYGLRTISLRLENICSGLNGGSFVNEGFSNSSGVISEKMNTTFKEGDLIALLNHIVTRIESCVTTLYLRQQMSIAHGEEGVLDIKSGKSLNMVMDDVALLVRAYREMLKIGGRGEEKHGYIENLG

SEQ ID NO: 141 - protein, 2034 aa, Saccharomyces cerevisiae YJM789
MSSKPDTGSEISGPQRQEEQEQQIEQSSPTEANDRSIHDEVPKVKKRHEQNSGHKSRRNSAYSYYSPRSLSMTKSRESITPNGMDDVSISNVEHPRPTEPKIKRGPYLLKKTLSSLSMTSANSTHDDNKDHGYALNSSKTHNYTSTHNHHDGHHDHHHVQFFPNRKPSLAETLFKRFSGSNSHDGNKSGKESKVANLSLSTVNPAPANRKPSKDSTLSNHLADNVPSTLRRKVSSLVRGSSVHDINNGIADKQIRPKAVAQSENTLHSSDVPNSKRSHRKSFLLGSTSSSSSRRGSNVSSMTNSDSASMATSGSHVLQHNVSNVSPTTKSKDSVNSESADHTNNKSEKVTPEYNENIPENSNSDNKREATTPTIETPISCKPSLFRLDTNLEDVTDITKTVPPTAVNSTLNSTHGTETASPKTVIMPEGPRKSVSMADLSVAAAAPNGEFTSTSNDRSQWVAPQSWDVETKRKKTKPKGRSKSRRSSIDADELDPMSPGPPSKKDSRHRKNRHSRHHHDRKDNESMVTAGDSNSSFVDICKENVPNDSKTALDTKSVNRLKSNLAMSPPSIRYAPSNLDGDYDTSSTSSSLPSSSISSEDTSSCSDSSSYTNAYMEANREQDNKTPILNKTKSYTKKFTSSSVNMNSPDGAQSSGLLLQDEKDDEVECQLEHYYKDFSDLDPKRHYAIRIFNTDDTFTTLSCTPATTVEEIIPALKRKFNITAQGNFQISLKVGKLSKILRPTSKPILIERKLLLLNGYRKSDPLHIMGIEDLSFVFKFLFHPVTPSHFTPEQEQRIMRSEFVHVDLRNMDLTTPPIIFYQHTSEIESLDVSNNANIFLPLEFIESSIKLLSLRMVNIRASKFPSNITEAYKLVSLELQRNFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTNLRTLNLRYNRISSIKTNASNLQNLFLTDNRISNFEDTLPKLRALEIQENPITSISFKDFYPKNMTSLTLNKAQLSSIPGELLTKLSFLEKLELNQNNLTRLPQEISKLTKLVFLSVARNKLEYIPPELSQLKSLRTLDLHSNNIRDFVDGMENLELTSLNISSNAFGNSSLENSFYHNMSYGSKLSKSLMFFIAADNQFDDAMWPLFNCFVNLKVLNLSYNNFSDVSHMKLESITELYLSGNKLTTLSGDTVLKWSSLKTLMLNSNQMLSLPAELSNLSQLSVFDVGANQLKYNISNYHYDWNWRNNKELKYLNFSGNRRFEIKSFISHDIDADLSDLTVLPQLKVLGLMDVTLNTTKVPDENVNFRLRTTASIINGMRYGVADTLGQRDYVSSRDVTFERFRGNDDECLLCLHDSKNQNADYGHNISRIVRDIYDKILIRQLERYGDDTDDNIKTALRFSFLQLNKEINGMLNSVDNGADVANLSYADLLSGACSTVIYIRGKKLFAANLGDCMAILSKNNGDYQTLTKQHLPTKREEYERIRISGGYVNNGKLDGVVDVSRAVGFFDLLPHIHASPDISVVTLTKADEMLIVATHKLWEYMDVDTVCDIARENSTDPLRAAAELKDHAMAYGCTENITILCLALYENIQQQNRFTLNKNSLMTRRSTFEDTTLRRLQPEISPPTGNLAMVFTDIKSSTFLWELFPNAMRTAIKTHNDIMRRQLRIYGGYEVKTEGDAFMVAFPTPTSGLTWCLSVQLKLLDAQWPEEITSVQDGCQVTDRNGNIIYQGLSVRMGIHWGCPVPELDLVTQRMDYLGPMVNKAARVQGVADGGQIAMSSDFYSEFNKIMKYHERVVKGKESLKEVYGEEIIGEVLEREIAMLESIGWAFFDFGEHKLKGLETKELVTIAYPKILASRHEFASEDEQSKLINETMLFRLRVISNRLESIMSALSGGFIELDSRTEGSYIKFNPKVENGIMQSISEKDALLFFDHVITRIESSVALLHLRQQRCSGLEICRNDKTSARSNIFNVVDELLQMVKNAKDLST

SEQ ID NO: 142 - protein, 2102 aa, Sclerotinia sclerotiorum 1980
MTRKDGSYRNSSATSSSTGSWKSTDTIKGPGSSYFQGSSTKRGAPMQVKTDRTSRVENDAQVSPTSAGPRNTISPSSSISPNVSPREQRMAADFGNYRRDLAVLETSGGRIPQIHHNPPTAIASTNPITPWMSTGSSATGSPNGFTSFYNDSSDALSQASQLSPIARPGTAVTGHTNTSESPADAFFGDGDERRPSVASITTASSTGSKSSLGRAVGGLHKKLTSFFGEDLPSSSETSLPSQGKEDITLYGEAPVRENLSGPDRERYINDSSDKPPKTSSSAKSHHLPGHHLRNRSNDDTRSLRPTVSREESAFSMRFKDRNNNPMGTAAANASNPNLQRPKSPTPSGMSTWSQTTKGGNSDGPSSPRDNNNGTKRSLLNLTGRFKRHKDKDHTPSRLKETPAASRAPINGSSKQDAGKIYESPDLAKYSQDGSITGSELNLPSQSTNGNARPPGGRQGTFPKLPFRKGRGNKGAEDSDQLYDTSDRSGDNVHHLDTNLSNMEGILTKPPPLTPLDNSIFNGEEDEGKEETESLGGLGWNAPDSWAVKKIDDDNMSRLPEIDEAGIPQKAEEKANPYCIRIFKADGTFATLSTSLNTTVTELLAQLNKKTYQADSLDNYQIVMKKHDLQRILAPGERPLVIQRRLLEQAGYQPEDRIEDVGREDNSYLCRFSFLPARQGGYASVSNDNGLGRVQKFSHVDLSGKNLITIPIALYSKTSEMISLNLSRNLSLDLPKDFISSCVNLREIKFLSNEAWKLPASLSRANRLTILDVSNNRLEQLEHAELSRLQGLISLKLANNRLKSLPSYFGMYRSMRTLNLSSNFLEEFPEFLCNMTALIDIDMSFNGISNLPNEIGKLKHLERFVITNNRLKGSLPNTFGELVNLKEVDVRYNMLSSIDIIATLPKVEQISADHNSVSVCECEFAKIRILRLNSNPVTKFEIKNLVPTLTTLNLSNAKLAQIPDAAFDKMPNLNKLVLDINHFVSLPAQIGKLRKLEYFSIARNALSSLPAELGCLTELRYLDIRQNNLKKLPMEIWWANKLEFLNVSSNVLDNFPKPGSRPPQPPGDVGSTNSNNTGANSQNSSFEELGPLDFAHRRPSQASSGLLSVGSSPVPDARKGSVVSVYGKGGRKTSVVSRSTSASTINHQTPTNIRKDSGLSAKLINTFAGSLKILHLADNGLDDDVFDEITLLSELRVLNLSYNDLNDMPSRSIKSWPQLVELYLSGNELTSLPSDDFEEFSLLQVLHINGNKFQTLPAELGKAHRLQVLDCGSNSLKYNVSNWPYDWNWNWNTNLKYLNLSGNKRLEIKPSLPGSAAARDGRDLTDFSALQNLRILGLMDVTLTIPSIPDQTEDRRVRTSGSLAGQLAYGMADSLGKNEHLSIIDMVVPRFNSTETETLLGMFDGQALSSGGSKIAKYLHENFGHIFSEELKRLNALNNETPKDALRRAFLSLNKDLATAATQNTEERSLLSHRGSATPAVLSQADLISGGVATVMFLQQSELYVANVGDAQAMLIHEKDGHRILTRKHDPAEPNERQRIRDAGGWVSRQGKLNDVLEVSRAFGYVQLMPAVQAAPNVEHITIKEQDEMVLIASRELWEYLSPELVVDIARYEKHDLMRAAQRLRDLAIAFGASGKIMVMMMGVSDLKKRAQIRPHRVQSLSFNPNMMMEDGYVPSKRPKKKTDDVDDSMLRRLQAEVQAPVGDIGIVFTDIKSSTALWETYPSAMRSAIKLHNEVMRRQLRIIGGYEVKTEGDAFMVSFPTATSALLWCFAVQSALLEVNWPAEVITSNMGHEVYDSNKNLIFKGLSVRMGAHWGRPVCENDPVTRRMDYFGPMVNRTARISAVADGGQITVSADFISEIQRCLETYSESDRSGSTGSEDAFDSDFISHSIRRELRSLSSQGFEVKDIGERKLKGLENPEYIYLMYPHALAGRIQFQRSLESGEAAVVEEEPATLARDSELSIDTENVWDIWRLSLRLEMLCSTLEEPRGSALQPPETAMLEKMRNRGGEVSDRFLLSFLTHQVSRIETCTAALATRHLVIGQSLISDLDQLRAPMAGIIEGLAADLQELQKYRAMYGPLEPLEPLEPSVYEYEDEDESEDL

SEQ ID NO: 143 - protein, 1963 aa, Vanderwaltozyma polyspora DSM 70294
MPDSSSLNSGASISSAGTRRQNTSSSQKNKKKKKKSLSLRRTFSGLSMTALGRSSGPTSGSESGGEPLDDSISLGNPHHHHAPSLFHGSSGASFSHQEHEQEHEQEQDQSSHHQSNRKYSFAENLFKKISPGSSSSVTASSTIPVMEPHLPYQQHYQQHSPTSSIFRKITSSAHSTPMGQSTSTGSNTNASISHKPFSMGPTRYSGTSSDVSGRSTTNQPKPSAKTTLGPTGTSSNANQKKLLESNINSRRSSIISTNLNNYPGLFKLDTNLENLSDITNQRYSSINELDQSSHLVPTLSVSHKSEKQRDQANSLTQWTAPENWDVESSIDNKQLKSSKKSVGRNNSNASSIFYMPGSEHTHQGDKVASQQTVSGGGSTGGTTSSTVSANSSSTDNSGDANVTGTAADLNAPSKRRDSVQPISRVNSKTMLQLQNKLSMTPSNIVPHPQHNADTQSNHTSSTTNSGEAGYYENDNITINSDEKRVAGDKDLEYSFSNDSIDSYDIIDDGNYEYDGNIGNDIYNDDPDLEQYRPAHEKVDRHNSDTNLKALKYSNKTKTTIIEDHDLSMNDDSNQTSNNFASIFSKDDELHDRAEYELEKYYKDVSDLDPNKHYAIRIFNTDDTFTTLSCTPNTTVQEMIPTLRKKFNISIQGNFQVSLKVGKLSKFLKPLSKPILIERRLLLLIGYKKTDPLHIMGIADLSFVFKFHFHPVAPSHLTAEQEQRLMRSDFVHVDLRRLNLTTPPIIFYQHTTEIESLDVSNNANIFLPLEFIESAINLSSLRMVNIRASRFPSNITEAYKLVSLELQRNFIKKVPNSIAALTNLTILNLQCNCLKKLPKGFGKLKNLQLLDLSSNYFVEYPEVINNCTNILQIDLSYNKIVSIPSSINQLVKLAKMNLSHNKLTNINDLSGMKNLRTLNIRHNRITTIKTNASNLQNLFLTNNRISTFDDKLPKLRALEIPGNPITSIPYQDFFPLNMTSLSLNKAKLSSIPGELFVKLARLEKLDISENNLTQIPSQISMLNKLIYLSIARNKIESLPKEFSKLTNLKTLDLHSNNIRDLVNGAENIELTYLNLSSNAFGNQAINGGEFFTKLSPSSKLAKTLMFFIAADNQFDDSSWTRFNCFKNLKVLNLSYNNFTDISNLELENLTELYFSGNKLISLPSDTILRWKYLKTLMLNGNQLLSLPSEVSKLSQLTVFDIGSNQLKYNISNHHYEWNWKDNKELRYLNFSGNRRFEIKSSASNDHDKDFADFTVLPQLKVLGLMDVTLNTTKVPDENFNFRLRTSGSVINGMMYGVADTLGQRNYVSSRDVTFERFRSKDDECLLCLHDSKNQSADYGHNIAKIVRDIYHKILRRQLEKYGEDDDGIKNALRFSFLQLNKEINTMLNSVDNGAKVLNLTSVDLLSGACSTVVYIKGKKIYTANIGDCMAILLKNNSDYQLLTNLHVPYKREEYERIRVSGGYVNNDKLDGGVDVSRAVGFFHLLPHIHASPDISVVKLTKADEILVIATHKLWEYMDYETACDIAREHIGNPMRAAEEMKDHAIAYGCSENITILCLSLQNNYEQQGKFNLNKNSLITRRATFEDATLRRLQPEIAPPTGNLAIVFTDIKNSTFLWELFPNAMRTAIKTHNDIMRRQLRIYGGYEVKTEGDAFMVAFPTPIRSLVWCLNVQLKLLDAKWPEEITSIQDGGLITDKHGMKIYQGLSVRMGIHWGLPVPELDLVTQRMDYLGPVVNKAARVSSIADGGQIALSNDFCAEFNKVMGYHEKVIKDNEPLERAYGEEFIGEILEREISLLENIGWVFYEYGERKLKGLESKEYITIAYPKSLASRHEFFGEEEENASIDAEILFRLRTASNRLDSILSAVRGGFIEKDQRKQNEGGGFISLNSQVQDAVMTSINEMDIISFLDHLVTRVESTVAMLVIHQKIGNKLDIVQSVEGQLGVFELLDKMLESDKYKTLEAPK

SEQ ID NO: 144 - protein, 2319 aa, Malassezia globosa CBS 7966
MHASASTPSGGGASDAPSRGGIVEQKVEETKREGAQMCDTISPWLREEDALRTPSTATGEGVLRSSVSKTGPAPSVLMSRVLSSSSSSSSSFSSSSPPPPLPVAPQVSSSTSTSTSSASASEPGSMPAPVPLTVLRQEMGPSTRLGPASTSMSSMQPSVSSPSFSSSQGGDGSHAKTGVSEGGSASREYSQHGQHGQHGQHGQHGQHGQHGLGLRTLNPFSLFRPGSSWRARSHSEDEKRQMTTSTPSGSMRKDKLERTKRLCIPRHGSLSRRVSAELEKNTPALFEPFHRAISLENPVHAGHEHGVTLDTNLDTIGDIIDPSRIGAVPCADAHLNTGSGRCLNQEPPLFPCTEGNGSTTPTGTSSPSSKSSTQGLPATILPTLSEGVRRDSPGSSSLSYGGDVNDERSSSLLSDKPCASCATDSNVSPKALAPALQFPSVPVMPATRTKSSWSPSPPSTSSSAHRPSVSSLHTADLSSRRARQVSMDESLGHRASMGEGPSAQDMRDAMQSPKPPQTPTPSDVRPTQAHSPSAPRPQLLSELQAEAAAQPAARMPLPPAQEQAQYPPSTNPAMSIAPFVMTLSSTTPTGTPSSEVAPPSGSSSSRADVALSSWRAPESWAVVSPSGEQDMKNVVGEYAEDEEPVPPHTSSAGSDHDGSVLSQVVIYEPAMDLSTPPLQTSMRTNPFDEPGTESKRPRFFRRAMSRTPPPAHVPGLGQGITPVHGAGPASSSSWSPSPTSTAGGTGMQLPSGAGTSSAEGAGDASSACTPTTTTTTTTPYSSTKMALMSVGNAAFGRRHRTPHLPFLRSRRGVGSGGMGGGHAGPSPSLSPGPGAGAGAGAGAGPDAVARYVTMHGDAPLPLAARNPPAPLVFRSTDVDPVAPTGKTFMRVYQQNDTYVIISCAVETTASEIAYALGRHATSVADTKGHRLFLYERGTDRPLAPSERPVRIFRRRLIQAGYTDADGLDELGRQDLSFLLRFVYRADRAPTLSIGMLKDQDHTYKHMNLQGMHLTMIPVPVYRCAQWIVSLDLSMNPLTDLPIDFVQLCTSLRMLRLSSLSLKRVPEGVVSIPQLTQIDVSSNRLVDLEHIPLHQLAQLRVIRATNNRLSSAPSYVPSMGALQYLNLSNNRLDTFPARVCAIPNLRDLDLSFNAISIVPSDVHRLTKLERLILVGNSISRLPAEMQSLVSLRVLDVRHTNLHMLGDVMALPRLEYVLASHNYVTSIEGDVGEALKTLDFAHNPLTRAQLSAPVPSSLTRLDLSHANLVTINESLFRSVPELRQLVLDHNQFASLPPLGSLGKLECLSCATNALTQLPDSIGSLRALQRLDVRDNNLRSLPASVWRCQSLRVLNASSNILSSLPMPDGGALDTMPLAASLVHLSVADNRLSDDVFAVLMHLPRLELLNLSMNEIYEVPSGALLALRALRQLFLSSNSLGALPAEDLEALQHLHVLFLNGNKLLSLPAELGRLKQLRAIDAGNNALKYNIANWHYDWNWNANPELRYLNLSGNQRFEIKPKIADVNGREKNLADFNRLHHLRLLGLMEVTMTHQPLPDETDHRRIRTTLAHVNAMPYGIADSIGSHDALQVFDLVVPSFRRDENESLFGLIEGRAHSSLAGTRIARFMTDHCARVLEDELVRLPSSTNAPNDLVPIAIRRAFLRLNQLYAEYILRVHAEHATGSAVRSSSHGSSHSHFHGSNAGAAGATGDASAHTHSSQEVFWGWGSGSSRDMHLWQSSATALLAYQRHRTLYIANIGNAVAVLSRAGGFVRVLGKRHDPLNRDETQRIRAAEGWVSLRNYVNDKTDVARAFGLFQLTPVITACPSVLSIELIDADEFVIIANTELWKFLSYQMAVDIARMDRENPRLAAQKLRDLAIAYGAKDHISVMVVTVAGLFHERLNAHVQNAHASQRGMDSTKKMLRRGRNDLDSTLARLEREVLPPIGQIALVFTDIKNSTLLWETNPSMQSAIRLHNLLLRRQMRSIGGYEVKTEGDAFMVSFQSVSAALLWCFSVQMRLLSIDWPQEILDSPTTQTVYSDDGTLLYRGLSVRMGVHWGCPVCEVDPVNNRMDYFGPMVNRAARISAAADGGQILVSRDVIQELERVFDMYKEHEHLPHTAGSEAAPQSCTPRDVVFLRRLGLGIISVGERRLKGIEAPEHLSLVYPKMLAARYTHLSGARRSSGLFQMYEPTQELLALAQVKQLGYLCLRLESLSNQRCFPGIDPNDPWSNAVYEGRRKPTQPVPSSHRNALVESCIAQTPDMLIVASREDATDAELFPILRQLITRIRNSIHTIALDFARNSMHTPQAQQALSILFDALDE

SEQ ID NO: 145 - protein, 1533 aa, Laccaria bicolor S238N-H82
MDYRKVSPKTVIPPGFNRIPINPSSTSNLNGDGPGSPTWTPPESWAVEKEEEEGGDDPDAAESSSDDTPRLSIISERPYRIRIYRANNTYHVVSIPFNVTVAALTPALNKKLLLGDDRVQHRLYLKERGRERILAQTEKPADIVRRRLEQAGYDPVDGLELLGGEGLSFLLNFLVLRYAYLFKQTLNMSLFIDQEEELNFNDNFDFIDLTGRSLRTIPVILHQHAHSIVSLKLSRNPMLEIPLDFIQSCSVLRELRLSNMAMKKVPQSVRHSTTLHRLDLSSNRLGDLEDAYLEHIPGLITLYIQNNRIEKLPWHFPRLRSLTTLNLSNNKFQTLPILITQLENLRDLDISFNMISEIPEEIGQLQNLERLIIVGNQVVKFPRECADLKRLRILDCRRNQISDLTVICALPQLNQLSADHNSIHGLDLALGVHLTRLDVSHNDITQVSLVPVGGPMMAYALTSLDLSYAKLSSLEDVALGCLSTLLTLNLAHNSFRSLPDTLGDLSWLETLSVSDNKLDALPSSIGRLQKLEFLDAHNNSLTELPQSLWNCANLTKINVTSNFLGSWHDPPVNVGVVQQEPPPPLPPQAAENNTLSVPAIERKTSTTSLTVTGNLPPLVYSLEKLYLGENRLTDDVLHPLMIFKELKVLNLSFNEIQELPPSFFRNMTQLEELYLSGNRLASIPTEDLPKLKCLSTLFLNGNKLQTLPQELCKAKNLTNLDVGSNLLKYNINNWEFDWNWNFNKNLKYLNLSGNKRLQIKAEPTRLYSNHRLSSRDPTAIGRRTLSGFTDLTQLRVLGLMDVTITTTSADATVDIPDENDDRRVRTSSSTVCGMAYGIADALGRHDSLNMLDLVHEFPGRKGEAIFAMFGRSRPPSNLLPGSSANRLSKFLHDRFVSQFLLQLDALDPHRGEIIPDALRRTFLKLNQDLHDTLFSSNRKMSQSSGTTGTSGSTFVDSATLRSGASGIALYFVGKTMYVANVGNALAVVSRQGVAQGVSRKHDPFDRNETARIRAAEGWVSPPGLVNDEVDVSRSFGYYSLLPVVNARPDICVWDLTDLDEFVIVANCGLWDYISYQTAVDIARTVARTERPDPMIAAQKLRDFAISYGADGSTMIMVIWVADLFKSSRSRQPTLDNVVDPQMYRTRKKDEILDRSIARLDIEVPAPVGHLALVFTDIRNSTHLWEANPGMPSAMRLHNNLLRRQLRFCGGYEVKTEGDAFMCSFPTALAAVWWALTVQVQLLHEAWPLELLECEDGKPLEDSQGRLVARGLSVRMGIHCGSPVCEPDPITHRMDYFGPMVNRSARINSSAGGGQIMCSTEIIREINAKILESESETEYSKLQPQQAIDAVKRMGVEVITVGEVKLKGLELPELLTLIYPSGLEGRQELKDGPTNPSASGSRVQFSAPQTRELGILCLRIEALASGRVFQAPSDRKASLETISLENESESQTPSGIFNADPDLLLPPMNDQSSDMDLMLVLDSLSVRIENALSALVEKFHPPTVDKSKFLSALLEGGVLDEGTLQHIASVLQGL

SEQ ID NO: 146 - protein, 2312 aa, Sordaria macrospora
MTRNEGGSRFSSLMGSSTDSARSSITAKPLVPLTPTSSVGSSTTRPPSPPQAGSSSSSGSQNGQQNVSRSASQGSRRPAPTRLKTDDGTQFASRSSRDFESSQSQSQSQSSHSQPRSHPVSQATLQFYHSQSQPPSQYQSQQTPTQQQPPQQHQQVSPTGGSSGGSRMVQQSPTTPSNASIREHRMSELGGYRREMAAMLDTTGGGGGSRTSSHSQQQLQQQQQGHAAGSVSGAFNNLGQYAPYLGGNNGGGGMSMGGSFFNESTDNLSVISQLSPGIRPMTARPSQASAGSMEFPDSAYYDDERRPSIASITTTASSQGSRTSKTRGGLQKLQQFFGDRDDWPGRDSSEISLPQPSHSGSMSTGKEHRSHSYSLGSGRSHRDRNYSNATDHHPSTFGSVSTAGGRDRDASPVPSRPRTPVPAPEVVPFLYQEADDIARYGEAPVRTSLTGPDRDRYIDSSQNPPKTSSSARSGHSIVQLPGHHKHNKSNEDPRTLRPSLSREDSGASFARDHRNGSSTMMGTRSRAQSPAPSWTGATRGLKGSSISDGTASPAPSHKKGLLGRFRRHNKDKDDGSGLRSGSNHTLVHRPSRQDLSRAAESAYPASVYGSDPTEQREPREVPVRPGYVRQTTAPGFTTKLFTSKKTSSVKQPQDDMDEDIGPTDTHMGGGTVYHLDTNLNDMEGILTKPQPMTPLDNSISMRRESEKMIVPITADPEGAWAAPDSWAVRDNKKSLATQAFESEELGSRQPTEEKEKKSNYYIRVFRSDSTWTTLTLPLTATAEDVIMGVAKKTYLPPGAQDSYSLLIKKHDLFRVLGSAEQPLRIQKRLFQQIGYQEKDGIDEIGREDNSYICRWVFLKEKEADMHLFSQDINFRNQKLNHVDLSGRNLITIPVPLYRKASEIVSLNLSRNLSLDVPRDFIQACTSLRDIKYNNNEAQALPKSFATASKLTYLDVSNNRLQDLDQSDLSRLTGLLKLNLANNCLRNLPPTLGAYKSLRTLNISSNFLDVFPSFICEVETIVDLDLSFNSINNLPDNLKKLRNLEKFVITNNRLSGPISESVRDLVSLRELDIKYNQISTIDVLSDLPRLEILSADHNQISKFSGSFERLRSLKLNSNPIVKFEVKAPVPTLKILNLSNAQLASIDESIDNLMNLERLILDSNYFVSLPNQIGNLKRLDHLSMANNHLGELPPEIGCLTELRTLDVHGNNMRKLPNEIWWANKLEHLNASSNILTEFPKPASRAPQAPGESSPPPGSYPFPNGKQNGLISQTPSTDDLNGDASRRPSQASSTLLGVAVSPVPSGPDNRKSSMVSLYGKGGRKTSVVSRTTTQSSSGVITPINGSRKDSSLSYRFTHTFSGSLKNLYLADNQLDDDVFEELKHLPELRLLNLSCNDLSDMPQGTIRSWPQLVELYLSGNELTSLPAEDFLEEHCLLQTLHINGNKFINLPAEISRAKKLQVLDCSSNNLKYNVTNVPYDWNWNFNRDLRYLNLSGNKRLEIKNNYRQPQSYRDDDFADTDFSKLTNLRVLGLMEVTHTLPNIPDQTEDRRVRTSEMKAGAYLPYGMADTLGKNEHLSLFDLVVPRLGSVETDTLVALFDGKELSTGGSKIAKFLYEEFSRLFILELEKVKGKPNENPVDALRRTFLSVNKLLMNLSNNADERGLDSHPGRNYTHTVLTKEDLNSGCVATVAYLSELKLYVANVGDVQGMLIQANGSFKMLTKKHDPADPVERSRIRNAGGWVSRNGRLNDVLNVSRAFGYTELLPAVQAAPEITEHTIDDKDETVLIASKELWEHLRPELIVDVARECRSDLMQASQKLRDLAIAYGSTNKLLIMMIGVANLKQRQAQRFKGQFNSAFSMPQDDPTHAPPSGNKRRKVRAEGPLDSNLIRLNAEVPAPTGQLSIVFTDIKNSTQLWENYPEAMRLAIKLHNDVMRRQLRMIGGFEVKTEGDAFMVSFPTATSALLWCFAVQMKLLSVDWPPEVLSNSSCQPTYDRNNDLITRGLSVRMGAHWGEPLAEPDPVTRRMDYYGPMVNKASRISAVADGGQITVSSDFITEIHRCLETYKEPVDVDEDYFEDDATAKAIRAELRALSSQGFEVKDMGEKKLKGLENPELVYSVYPHALVGRTEQHLAHAESTQNPAALQPPGALAAPKPATMDPDSEIQFEPETIWGLWRVALRLEMLCSTLEEPNARGLQAPETELLERMKQRAGEVTDHFLLNFMEHQISRIETCITSLAVRHIAIGSGPITKLNDLRAPMNDVLSTLKEQMDELARYKAKYGSLDQEAGTDGAATDSNSISDDVDTLDGSDTEQE

SEQ ID NO: 147 - protein, 2152 aa, Penicillium marneffei ATCC 18224
MARRNGDLESLNERHGSESSTSSYHSQSTVRDDTIENGLRNGHRSGDQTPQSGSMNRTASGRQANLPSPPELYTSMFSHSPSISPTDSRKPSMQSHRKALAILGADDFFSLNSGPPQPPPPASGSYQLTLNPMVHEPFRASWMSPASPDQTEPPNRNSGTFLQDASEHEVSPITPAFRHGNENTSGSDIHDFGYKEFRRESAASATSSNSKSSQNGHIRRRLQGFFGGSAGDENGPAESSGREDCDSNIQNREIPMSRHRNDSTASKTISETSKTRTLSPRPSRPRTPLPSSEVTPWMYQQYNDIPHYGEAPIRKEPTGPDVQRFTNGKAASIHSDHKTSHKLPFTGRRHSRSKEGKPTSSASFESALRSTAAANAQDDDANPHLRDARGLLANTAMSSSSTLAGRPTSPAPSAQSSIIQRDTGSGHDSPGPVRGFVHRILRSKPSTLKSLPGSEKSLHDAIRTAAKVPRRDASPFRHRPGSLDDSVVGRHGDSLEYDRKRDGKGLGIHAHKHKKGRKYTSNKSSPYREQNIFQLDTNLNDMKGIVSEPRPHSPNNQTFIFDGNLPEDRLPQEHQVGDWNAPDSWQVKKQGDDLVRALPEIDDELEAAAIHDSSSYFIRIFRIDSTFATLSASLNATVADILELLGKKSFLQDDLKNYEIVMRKNDLSRQLEHGERPILLQKKFLEQVGYLPKDRIEDVGREDHSYICRFIFLPTKLNAYVSLDADPGFNKSQKFSHVDLQGRSLATIPITLYKRAPEIISLNLSRNLDMDVPSDFITSCINLREIKFMSNEAWRLPSSFRLATRLTYLDASNNRLDGLEYTDLSELHGLVSIKLANNRLSSLPSYFRDYSSLRSLTLSSNNFRVFPEFLCNLPNLVDLDISFNSIRELPHIGRLKQLERLWVTNNMLSGPLDKSFQGLKSIKEIDARFNAIENVDSIMRLPRLEQLLLGHNAVTKFKGNFPKLRTLVLDHCPITQFELDAPIQTLTSLNIASAKLVQLKDSTFENLPNLTKLILDKNFFSSLSPYIGKLRRLEHFSMIKNPLKSLPPTIGCLTELKHLNLRECSLERLPSEIWFCLKLEHLNVSSNILDGFPKHTGQPPLPPGEYVSPSPATTPGLSNTPSYEDMGSSDDAQSRRPSQNSSGLLSLAGSPGIGRNNSLQSAYIPGGRKASTASRAYTEGSSSTRKDSNFAQRLATTFSGSLRNLYLADNRLEDDVFRELAYLPELRVLNLSYNALTEVPQGYLKRWQNLTDIFLSGNELASLPSDDLEETSNLKTIHLNGNRFQVLPAELCKVSKLAILDVGSNLLKYNVSNWPYDWNWNWNRNLKYLNFSGNKRLEIKPNIASLGSNSVNGTDLTGFNSLTHLRILGLMDVTLTIKTVPEETEDRRVRTSASLAGSLAYGMADFLGKDEHLSIIDMMVPRLRSDNMDTLVGMFDGQSQSIGGSKIAKFLHENFTQCFVDELKRLSPDTETPLDALRRAFLTLNKDMAAAAYKSIDDKEVHQFARGSAAAKLLNKDDIHSGGVATVLYLKNMDLYVANVGDAQAVLVKSDGTLRPLTFNHDPAEPGERNRIREAGGFVSRNGKLNDVLPVSRAFGYFPLIPAVVAAPHTAHFTLTEQDELIIMASREVWDYVTFDLVVDVARAERRDLMIASQKIRDLAIAFGASNKLMVMIVGVSELKKRERYRKLRNASLSVGPSSFPEEVLPPKRTRRARDAVGDSRLARFNFVDAPVGDLAIIFTDIKKSTSLWETFPEAMRSAIQIHNDILRRQLGIVGGYEVKTEGDAFMVAFSTTSAALLWCFNCQTQLLEAEWPKEILEQPQCKERYDKDGNLIFRGLSVRMGTHWGEPVCEKDPVTNRMDYFGPMVNRASRISTVADGGQIFVSSDFMSELQRTSEVYAESERSLSVSSESDYGDPLQNIRRELQQLNSQGFVVKDQGEKKLKGLENPEALYLICPHSLSGRLAAQEGDFQDQEDLGPPTIKKGSQLDIRTDQIWQLWEITLRLERLCGSLETPGIGESNAPYRQLMYAIQRGGGELADATILGIVESLITRTENCINTLIIRNMMRPFKRGDSIRDHAIPMTDVFLQLQSQFAEFHALKEHLNIAATGAPDPSTQIGLNLKTPGSQSQSSGTNSSSSSHIRLLLSPPSPDR

SEQ ID NO: 148 - protein, 1674 aa, Schizosaccharomyces japonicus yFS275
MFSPPSSSFKTGIPWLDVSDSEDESGDEHMNPSGFFGKSYSDLSPNYEAFSPLTTPKSVKNSVSQGRVPASSHDNDSDDYFYSRSPRAVSPTGKQSSDFSRQSSFASSSSLGKSPVSEHSANGFSFKNLSFDHNIPMDSSSSTEEIETSEPDRQGEYSDREAQKLFSEGTSTPAQTDGSQTPTSNWVYGDASDLSGIHGRGSYDDSSLGTDSLLGDTDSLKNLMSIPNHNHTTAENIPSDEYWEPPESWGTIKPYDQSHEFTPHVYTKPKEPEDTQPFQLRIYRADKSVVSFTCPMNIRAHEVIRIVAQRFFLPYPAPYYLLLVFFNRERILLPDERPCYIYKNFLKDFGYDFNYRDSPETNDDFGIARFVFTTMDIGASLGKKVPRFTSYENIDVSGLNLEVLPVKLHRHAAEIRKLNVADNLSLKIPNDFLEACTNLEVLNLSGNMRLPEGKSIVSLKKLKVLNISLNDLYEVNPELLAETKATNLRKLYCSSNKLFFLPYPLLYLSRLTYLDLSFNNFTTVPISLVEITTLQHLDMSYNYLLYIPPEIKRLKELKTFYFQFNSVYGVLPEEFGSLNKLETIDLRNNKISDISSLSGCSRLKQIFASGNPISQHESSLSNAVRLDLSHCPMTIFDVPTSETTPLRYLDLSYGKIVTINPSTIQCWSQLEYLNLSYNHFNALPGVFSEMINLKRLLCTNCEISEISPDIGKLKHLELLDLHSNNLKHVPEEIWMIPSLTEVNLSSNILEQILLPAPKPTERAVHRLRLVRTLSGRSLSGSDFDQHSIPPVRELLLVDNRLSDTCFATLRKFKHLRLLNLSYNYITEIPKGFAEKLSNLQRFYISGNRLSKLPIVELQRLNLELLYVNSNRLTQMIFEDTPFPSLLALDLSNNNLQTVNVGRDTQASTTRVYTKLRYFNLSGNPWLAPFKRRREHQRKELINVLNKIRVLSLLDIEENVFTSTTDILNRIVRTGNTEDKLLSYGVCDSFGTNMDALSSVELVIKEFLGPMSSLYCVLDSGSPTESAAKVLRFVYDNLPQCLAEELSNHYSSTEWIFRAIKNAFLNLNKLLALAFYDDLHSKGGEIDQGPKRYVKKGYFFDKSCVDYGCSVILVYLRDTRAFIANAGTAEAIISKRTDSEPTAISKPHSSNDPMEIRRVIDQGQGSSSNVEFIRKYEVTRGVGYLSQVPFVISDPFITVENLSELNDFIVLANSNLWKVLSTHALIDIVRSNYRSPMLSASKVRDFALAYNSKEPFTVVVIDLKRRFGTQTPVIPKLGERGTMKEEEEAALNLQALHNLPDDSALARLSKEVSPPRGCIAMVFTDIKNSTQLWERHPVAMRSAIKTHNTIMRRQLRATGGYEVKTEGDAFMVCFQTVPAALLWCFSVQLQLLSADWPKEIVESIHGREILGERNEPLYRGLSVRIGVNWGVTVSEMDPITRRMDYYGPMVNRTARIVAVADGGQIAISNDVVNALQQLDSENAPSERSYETEMELRSLKQMGYVVHYMGEYKLKGLENPERISLIYPLALEGRLERILKKSSSGVQTSFDKGIVNRPRSRSNSLRPIIGRLSESRSVSEDYRRRSVSSLRGETFSDPNLRFPAGIFDNSLYQHLLELCERLEDSAALLHGYPEAPECSIGLAAPETIGEEFAMLYRLTLRIENTIYCLRKMLRNI

SEQ ID NO: 149 - protein, 1696 aa, Ajellomyces capsulatus G186AR
MARRQRPQDRDLRQGSESSSAGSWRSHDTATQGDHSHGLGQASTSRHPVSVRTSGSDPRLHREGKVGVDNYLNLRLRPIGKPRSSSRSNRSARSTRSANRRSYSPDVSPTDTKVGFGSHRKALALLGAAGYPPPYFPDIPRETQRRRSPSWTPPSSLEPSALKSARPPGTFLNDGSDQETSPAFPPTATDHVGRSDSPDNPMEPDHRRPSAASATTISSQGSKDSTARFHKCLQRFFGEDQGNISDSALTQAPKVRERNNSTHSLKPITRSFSPHGGGGPRPRTALPSSDVAPWMYQRFNDILNDVDQPVHAASTDPELAHFAGTTGESNVDKDSHVNAVRHRHSRSGDEKSAYLATDFPHIFQPSDQENPKLAYSRLKDGALSPTSSSPTFAARSTSPSPSVRSGNGQRSPGGTSNKRSFFTKIRRHPKVPIASSLRHTPASSRTVPDGNAKGPKFLRRDGSPARRGRNASFDSITNTKPWDMSDSDRKKESSGKGVSKFRHPRFPFSHDGGQKYQDKNQRSIFDEDRVWKLDTDLSNLSGIVAQPRLSPTDVYTGPPHPELKEKDFQNPFEVSIAGDWHAPESWAVRRAQDDILSRFPGLPDHSIPVDEEGRPYCVRIFRIDSTFTTLSATLNTTVTEILEMLGRKSFLQDELNNYDIVLRKNDLSRTLEYGERPILMQKRLLEQAGYQQSDRIADIGREDNSYLCRFTFLPTKLSGYSSLDTDLGINEGQKFSHIDLSGRSLITLPITLYKRASEIISLNLSRNLALDIPKDFIQSCINLREIKYIGNEAWRLPASLSLATRLTYLDISNNQLENLDHAELHNLHGLISLKITNNKLSTLPAYFGDFPLLRSLNISSNSFTCFPEFLYNLRNLVDLDISFNKITELSNIGRLKTLERLWVTNNGLHGPLGETFRDLVNLKEIDARFNSITSIDNITQLPRLEHLMVGHNTVSTFSGFFPKLRTFTLDHCPVTEFDITNPVPTLTSLNIASAKLVQFKDSLFTNIPNLTKLILNKNHFVTLSPYIGTLRKLEHFSIAKNPLSTLPPSIGCLQELKNLNLRECNLSKLPAELWYCCKLETLNVSSNLLDSFPKVSDSPPVPPNELPVNGTPATTPGISSPNFEELGKLEDFETRRPSYASGGLLSVGSSPSNSYTNRQVTLTAQDEMIILASGELWDFVAPDLVVDVARSEHGDLMIASQKLRDLAIAYGATNKIMVMIAGVSDLKRRGERPKLRTPSLSMGPSPLADEHLFPPPSKYRKRGAPSDSRLARLNRVEAPTGELAIIFTDIKKSTSLWETYPVAMRSAIQIHNDLFRRQLAQIGGFEVKTEGDAFMVSFSTATAALLWCFTCQSQLLEAEWPTEILESQACRAQYDSDDNIIYRGLSVRMGVHWGTPVCEKDPVTGRMDYFGPMVNRASRISAVADGGQIFVSADFVAEIQRNLETFADYDQVGSTDASEGGFDDYLSNNIRRELYQLSTQGFEVKDMGERKLKGLENPEFVYLMYPHSLAGRLNAPCYSIEEADTLPISIGRDMHLTIEAGLVWRLWTVALRLEAFCSALENCGEVGVRQPEMSLLNVVKARHGEVTDAQVWSLIEHQVTRVETCANTLTIRHMIRPFNSAAALKDIAIPMADILTELQVQLSEFKALKEQIDPPSLASHQIPHPAVSVLKSANQSSSAVSDMITGSGSRSGSSPA

SEQ ID NO: 150 - protein, 2141 aa, Paracoccidioides brasiliensis Pb18
MARRQREKDRNLRRGSEMPSSLLWRSPDALLISQGLGLEREPRRPSRAREISDQDDRSCLGTSEAFILFKIHSSSSKSNRNAPHRPHSPDVSPTDVPTTSFGNHKKALAILGASDDPSVSQMFLQYSSTNARKRSPSWTPPASLKTTATRGTFFNDGSDAEETSPQFQLEAALTDPSNSPEPVHDEHRRPSVASATTVSSQGSKGSGGRFHKRLRGLFGDEHGSASDSALPERSLSNRIPMSSGSQSKVRERNNSTPSLHPPERSPPLGRGFRPCTPLPSSDDISNYGDAPVYPVPGDPDVERFGSMTDGERDSKKDSRLPFHRHRHARSKEEKLSDQGSNLQHIFRSSDHDNHKQVYSKVKEGTLSPTIPTALGARSISPSPSLQGGSGQDSQGTRSPGGSSNKRSFFTKIRRHPKPPIGSSLRGMPSSKSAYDGGGKGSRFLKRDMSPARYGRNSSFDSVTNTKPWESVESDRKKESAKGVSKFRHPRFPFGHDTGNKDDKTHQDNFEQDRIWKLDTDLTNLSGIVAQPQPLSPTDCGGIYTGTPLPEHKEREFRNPFEPSSTGDWHAPESWAVRKVGDDILSRLPELTDDGGAMVDDEGRPYCVRIFRIDSTFTTLSSNLNTTVTEILEMLGRKSFLQDELNNYDIVVRKNDLSRTLDYGERPILMQKKLLEQAGYQPSDRIADIGREDNSYLCCFTFLPTKLSGYSSLDADLGINENQKFSHVDLHGRSLITLPITLYKRASEIISLNLSRNLALDIPKDFIQSCINLRELKYIGNEAWRLPASLSLATRLTYLDISNNRLEQLDNAELHNLHGLVSLKMSNNNLSTLPAYFGDFPALRSLNISSNSYRTFPECLYNLKSLVDLDISFNKISELSDIGRLTTLERLWVTNNGLHGPLGETFRDLVNLKEIDARFNSITSIDNITHLPRLERLLIGHNSVSTFSGSFMKLRTLALDHCPVTEFDLTSPLPTLTSLNIASAKLVQFKDTLFTNIPHLTKLILNKNHFVTLSSYIGTLRKLEHFSISKNPLSTLPPTIGCLTELKCLNLRECNLNKLPSELWYCSKLETLNVSSNVLDAFPKIAGSPPIPPNEYHGNGTPATTPGLASPSHEELGKLEDFEARRPSHSSSGLLSVASSSANSSNRKGSIVSMPHNPTVKKSSVISRAATETPSSRKDSTFSQRISFTFAGSLKQLYLADNRLEDDVFQQLAFLVEIRILNLSYNELTEIPQGLLRRWQYLVELHVSGNQLSALPSDDLEESSSLKVLHINGNKFQVLPAELCKVNRLAILDVGSNSLKYNVSNWPYDWNWNWNRNLKYLNFSGNKRFEIKPNTSYTSGIPAVNSTDLTNFNSLKHLRVLGLMDVTLTIPTIPDQTEDRRVRTSSSLSGSLAYGMADSLGRNEHLSIVDMLVTRFRGNQTETVLGLFDGQSSSSSGSRIAKYLQEHFTTSFTEELKKLRPSGETPLDALRRTFLGLNKDIATAAQRSSMDDRELHHFERGTTTSSKLLTKDDYNLGGVATVLYLQNMELFVANVGDAQAVLVHSNGDFKFLTCNHDPAEASERERIRAAGGFVSRNGKLNDKLSVSRAFGYYTMMPAVIAAPSTRKVTLTAQDEMIILASGELWDYVTPDVVVDVARSEHGDLMIASQKLRDLAIAYGATNKIMVMIAGVSDLKRRGERPKLRSHSISMGLSPLTDEHLFTTPSKIKKRGRPGDSRLARLDRVEAPTGELAIIFTDIKKSTSLWETYPVAMRSAIQIHNDLFRRQLAQIGGFEVKTEGDAFMVSFSTATAALLWCFTCQSQLLEAEWPTEIMESPACRPQYDSDDNIIYRGLSVRMGVHWGTPVCEQDPVTGRMDYFGPMVNRASRISAVADGGQIFVSADFVAEIQRNLETFADYDRIGSMDSSEDNYIDDYLNHNIRRELYQLSTQGFEVKDMGERKLKGLENPEFVYLMYPHSLAGRLNAPRAEIEEADTLPIPLGQDKHLSIEADLVWRLWTVALRLEAFCSALENFGEIGLRQPEMGLIDAVKQRPGELSDAVVLSLIEHQVTRVETCANTLTIRHMMRPFKRGNSLKDIAVPMSDILNQLKVQLSEFRALKESISPIADSQDPQQSLAVLKSPIQSSSALSDIMAVGGSSSSSTA

SEQ ID NO: 151 - protein, 2160 aa, Magnaporthe grisea
MTRNDALSRFSSITSSSTDSAHSTATVKPLPSTPIASDTRRHSSGSRPAIPSRLRIDDDLNRITASPLRDDTQVSPTNTFGTRVALSPSSPTSNVFPREQRLSDFGNYRRDLAVLDPGGSRVPQIQQPPPNTGPSLSSQVAPWMTSNGTGGAPAAINTSFYNDSSDNLSVASQLSPGFRIPGGRPSISQPSGVGADNNEASYFGDERRPSIASITTTASSQGSKASGNRGGFRKLQGFFGEEFPGRDSSDTSLPPAVPGKEHRSHSYSHGRPYRDRNYSNATDHTRDGSPSSSRPRTPVPAPEVVPFLYQEADDIAKYGEAPVRDILSGPDRERYVTGDSLQNPPKTSSSSRSGHSLAHLSGQHRHQKSNDDPRTLRPTMSRDDSAVPTYKDRSGSATTMMTTSRDRAHSPAPSGHSIGGYFSSKNGTYDGQTSPPGHQKKSLLGRFKRNKDKEDTGSLKKTSPSSTSLNLKPSRSEFGGDGASTMGQDWPSRLAEPSQYNSNSNSASARPPQARHGTFKSPFAKRGRTHHRHDDRDEAIGPTDKHDGMQAGGTMFHLDTDLNDMSGILSRPLPLTPMDADFVGTIKGEKSTVTSNGRNGAWDAPDSWAVKRTGDDLAYHGPENDEAGPSPRPEEKMTSYCIRVFKSDGTFATLQMSIDSSVQDLIGQLSKKSYVSGGLEYHIALRKHGLIRVLGSAEKPLFIQKRLLRQVGFEERDRIEDIGREDNSYLCRFLFMSSRELEQQARTQDLGLGRTQKFNHVDLSARNIIRIPIYLYSKVQDIISLNLSKNLSLDLPRDFISSCQNLRDIKFNNNEARKLPASLGRASRLTYLDVSNNRIDHLENAELNGLVGLLKLNLANNRLKHLPPYFGAYRSLRTLNVSSNFLDKFPSFLCELESLVDLDLSFNLIGAFPPAIENLRNLEKLVITNNRLAGTLPDSFSRLQSLRELDIKYNAISGIDVISLLPKLEILAADHNAISQFVGSFERVRSLKLKDNPITRFELTSTVPTLKLLNLSNAKLASIAESFNHMLNLERLVLDRNHFVSLPSQIGRLRRLEHFSIAHNALAELPPEVGCLQELKFLDVRGNNLKKLPLEIWWANKLETLNASSNVMTDFPKPASRPPQPPESSPGSMQGSNGKVAMVGSLSTPPSIEDLDPDDSRRPSQASSSTLLSVGPSPVPAGPDRKSSVVSVYGKGGRKTSIISRSANSSGNAPAPPNTRKDSGLSARITNTFSGSLRNLFLADNLLDDDVFDQIMLLCELRVLNLSFNQISDMPQRCIKSWPQLSELYLSGNELTTIPVDDLEEYSLLQVLHINCNKFTNLPADISRAKKLAVLDCGSNFLKYNISNVPYDWNWNLNPNLRYLNLSGNRRLEIKQPAYGSGAGNREQYTDFSRLQNLRVLGLMDVTLTQPSIPEQSEDCRVRTSGSSAGYLPYAMADTLGKNEHLSTVDLVVPRFNASETETLLGLFDGQALSSGGSKIAKYLHENFGQILATELRALKTGLKETPEDALRRAFLALNKELVTIAIQHSEDRPSVPHRSGSQAHVILNKEDLNSGGVATVVYLQGQDLYVANVGDAQAMIIQSDQTHKMLTRKHDPAEPTERSRIREAGGWVSRNGKLNDQLGVSRAFGYVDLMPAVQAAPHVSHVAIREQDEMILLATSELWEHLAPELIVDIARQERGDLMRATQKLRDLAIAYGSTNKIMIMMISVADLKRRTERTRINRGQSMSIHNLSLHGEQYKFPTRGRRKKDQVMDSTLQRLEAEVPAPTGMIAIVFTDIKNSTNLWETYPAAMRSAIRLHNEMMRRQLRRIGGFEVKTEGDAFMVSFPTATSALLWCFAVQLQLLEVNWPSEMLNSLSCKPTVDKNNQVIFKGLSVRMGIHWGEPLCEPDPITRRMDYYGPMVNKASRISAVADGGQITVSSDFISEIQRCLETYQGANAAALVNESFDEDPFSMAIRKELRSLSSQGFEVKELGERKLKGLENPEVVYSLYPHQLAGRIETHQAHDKGVTAAAPELIENTPAVLKEGSELDFDPEIIWGLWKLSLRLEMLCSSLEYVGGRGLQAPETELLERMKQRGGEVTESFLVNFMEHQISRIETCVSTLSIRHLNMGGGTIKELDDLRGPISSVLANFSKQMAELQRYKALYGPLDAIEDGQQAS

SEQ ID NO: 152 - protein, 2144 aa, Aspergillus flavus NRRL3357
MSFQGGDIPEGRRSSESSGGNSWLSQETVKDNQTNRYQRNHAMLNGRLISPFSGFAKADRSTSQGRKQPPTLGAHDLSTSNFTWPSPDVSPTDKRKDSGFTGHRKSSAAIGPDEPGPPPTFSSSPRISCPNSDEVDYFQQDPNASYSSSPKIAPGDGNGAFFQDHSEHEASPASTSFRPGTSRTYASEPLELDYNGDHRRPSVASATTISSQGSKSSTGGRFRKKLKGFFGEDYLPGDSKLESDNGSQHPTKKSSLSEQHIFRERANSDGARSPPQRLIGESSPQRPRPRAPLPSSEITPWVFQSFNDIPQYGEAPVREAPIGADGRRAAAQMARGSQRNQTGRQFSGHRHSRSKEEKSTTADDITVYPSRPTTGRDDFGIGLRANSLNNSAMNSTSTLVRSTSPTPSMQSAHSREQGQSSPGTQLPNKRSILDKIRRPKAHGPLKHFPGAKGVQEAKSTSKLARRDVSPARRGRQGSLEGTTTPKTGDESDRKKDGRGLAISSAKLRGRRVLGTDTPSKDTKPAEEQEGMYELDTDLSHMEGIVRKRSPQPSADRNQSVDGDSKLHEEGKSRDGLPTGHWDAPDSWHVRRHGEDNAPPFPSGDIEVARTVPQPDGAPYFIRVFRVDSTFATLSTGLNATVADILVILGRKSFLTDHLHNYEIVMRRNELTRQLDPSEKPILMQKEMLERIGYTSKDRIEEVGREDHSYVIRFTFLPNKLNGLTSLQGGDSGFNRNQKFSHVDLSNRCLVTIPISLYSKAAEIISLNLSKNLSLDVPKDFIQGCINLRELKFIGNEAPRLPASFGLASRLTYLDVSNNYVEQLDNAGLDKLQGLVSIKLSNNKLTSLPSYFGNFAYLRSLNLSSNNFRVFPEFLGNLKNLVDLDISFNNIAEVPCIGRLSTLERLWMTNNVLRGALDESFKDLVNVKEIDARFNEITNIDNLSYVPRLEQLHVGHNAISKFKGSFPKLRTLLLDHCPITQFDIDAPMPTLTVLNIASAKLVQLRDTLFENAPNLTKLVLDKNHFVSMSSHIGKLRKLEHFSIIKNPLDALPATFGCLTELRYLNLRECNLSRLPPELWNCNKLETLNVSSNVLDSFPKHGTPMPQLPGELVPGTPGTSTPTNYEDLAADDQEGRRPSQTSGSVLSTGGSPNGSGGYRKPSVASSLSQGGRKVSTASRSLNEGSPASRKDSSFSNLSNQTFCGSLRNLYLADNRLEDDIFRELSLLTELRVVNLSYNELTELPQGLLKRWSNLTELYLSGNELTSLPSDDLEEGSQLKILNINANRFQVLPAELCKVSKLSILDVGSNSLKYNVSNWPYDWNWNWNRNLKYLNFSGNKRLEIKPHVSSLLGPPNTNGTDLTDFNSLTYLRVLGLMDVTLTTSTIPEENEDRRVRTSASLAGFLAYGMADFLGKSEHLSIIDMIVPRLKPDNVETVVGMFDGTSQSTGGSKIAKYLHENFLRTFSTELRKLRRDLQETPLDALRRAFLALNKNMAAACFKTFDDKTVQRYEEPPDQKSRKLTNEDGASGGVATVLYLRNMDLFVANVGDAQAILVKSDGSLRHLTRTHDPAEPHERARIRAAGGYVSRQGKLNDVLPVSRSFGHFHLMPALIAAPHTMHVNLTEQDEMIILASRELWDYVTPDLVVDVTRAERRDLMVAAQKIRDLAISFGANNKLMVMILGVGDLKKRDRQSKFRNASVSTGMLEEQQILPTSKRTKKPRDMPGDSRLARFEFVDAPVGELAIIFTDIKGSTSLWETCPDAMRSAIQIHNDILRRQLGIIGGYEVKTEGDAFMVAFSTTTAALLWCFNCQMQLLEAEWPTEILEQTQCQVEYDMDNNIIFRGLSVRMGIHWGEPVCEKDPVTNRMDYFGPMVNRASRISAVADGGQIFVSSDFMSDIQRNLEVFADSERAASTGSEEGYAVDNLGYNIRRELQQLNSLGFVIKDQGERKLKGLENPEPLYLIYPHTLSGRLSIMQKDAASDKNVPTTISKHSQLEIQTDLIWRLWEITLRLERLCGALEYPGEARLKEPNVSLFNVVKNHGGELADSTVVSLVEQQVTRIEMTVNTLAIRNMLRPFRPHDRLNDHAMPIGDVLQELQTQLAEYRALKEQISVSAAGITGSSPSYTASLEDSNSSVSSSFLRMSIP

SEQ ID NO: 153 - protein, 2098 aa, Ajellomyces dermatitidis ER-3
MARRQRTRDRELRQGSESSSTGSWRSHDTARQGSQSHDQGQGPADVRPTPVRSSGQEPRLRPISKYRSSSRSNRSVRSSSRRSYSPDISPTDMRSGFSSHRKTLALLGAAGYPPPYFPDPPRPPLRRRSPSWTPPPSLDRNALKPSGAPGTFLNDGSDQEVSPAFPPAATARTGGSDSPDDPMDQDHRRPSAASATTVSSQGSKDSTGRFHKRLQRFFGEDQGNMSDSALSHPPKDISNYGDLPIHGDPTDPDLARFTGTTEEQNPDKDSRRKKTARHRHSRSGEEKSVYLGTEFPHIFGSSDQENPKPAFSYLKNGALSPTSSSGTFGARSTSPSPSVRSGHGQRSPGGSSNKRSFFTKIRRHPKVPIASSLRHIPASSKAAHEGSSKGAKFLRRDDSPARRVRNASFDSVTNPKPWEMSDSDRKKDNLGKGASKFRHPRFPFGHDGGHKYHDKNRRNTFEEDRIWKLDTDLSNLSGIVAQPRPISPTDSGGIYTGPSQPEERKNKKEFQNPFDAHVAGDWHAPESWAVRKAQDDILSRLPELPDDGIAVDEEGRPYCVRIFRIDSTFTTLSATLNTTVAEILEMLGRKSFLQDELNNYDIVFRKNDFSRTLDYGERPILMQKRLLEQAGYQPSDRIADVGREDNSYLCRFTFLPTKLSGYSSLDTDLGINESQKFSHVDLSGRSLITLPIPLHKRASEIISLNLSRNLALDIPRDFIQACINLREVKYIGNEAWRLPASLNLATRLTYLDVSNNRLEDLDHAELHKLHGLISLKMTNNKLSTLPANFGDFPLLRSLNISSNSFSCFPEFLCNLKSLVDLDISFNKITELPNIGKLTTLERLWVTNNGLHGPLDETFRDLVNLKEIDARFNSITSIDSITQLPHLEHLMIGHNAVSTFSGMFPKLRTFTLDHCPVTEFDITSPVPTLTTLNIASAKLVQFKDSLFANIPNLTKLILNKNHFVTLSPYIGTLRKLEHFSIAKNPLSTLPPSIGCLQELKNLNLRECNLSVLPEELWYCCKLETLNVSSNLLDSFPKIGDSPPIPPNELPVNGGTPVTTPGLSSPDFEELGKLEDFETRRPSYASGGLLSVGSSPAGSHTNRKGSVVSLNNPASAARRSSIASRTPTDQASSRKDSSFSQRISLTFAGSLRQLYLADNQLEDDIFQQLVFLGELRILNLSYNELTELPQGLLRRWQHLVELFVSGNQLSWLPSDDLEESSSLKVLHLNANKFQVLPAELCKVNRLGVLDVGSNSLKYNVSNWPYDWNWNWNRNLKYLNFSGNKRFEIKPTTSYASGSPTGHGTDLTNFNSLNHLRVLGLMDVTLTIPTIPDQTEDRRVRTSASLSGSLTYGMADTLGRNEHLSTVDMLVTRFRGNNCETILGLFDGHTSPNGGSRIAKYLQEHFTSTFTDELKKLRTGGGETPLDALRRTFLSLNKDIATAAQRSMDEREQRHLDRAGPPSSKLLTPDDYTSGGVATIVYLQNMELFVANVGDAQAVLVHSNGDFKFLTRNHDPAEAGERERIREAGGFVSRNGKLNDKLSVSRAFGYYPMVPAVIAAPSTRKVTLTTQDEMIILASGELWDYVAPDLVVDVARSERADLMRASQKLRDLAIAYGATNKIMVMIAGVSDLKRRGERPKLRTPSLSMGPSPLGDDHIFPPPSKYKKRGAPSDSRLARLDRVEAPTGELAIIFTDIKKSTSLWETYPVAMRSAIQIHNDLFRRQLAQIGGFEVKTEGDAFMVSFSTATAALLWCFTCQSQLLEAEWPTEILESAACRPQYDSDDNIIYRGLSVRMGVHWGTPVCEKDPVTGRMDYFGPMVNRASRISAVADGGQIFVSADFVAEIQRNLETFADYDRASSIDSSEGAYFDDYLSNSIRRELYQLSTQGFEVKDMGERKLKGLENPEFVYLMYPHSLAGRLNAPRESIDDPDTLPIALGRDKHLTIEASLVWRLWTVALRLEAFCSALENFGEVGIRQPEMSLLNAVRERPGEVTDSLVLNLIEHQVTRIETCANTLTIRHMIRPFNRANSLKDIAVPMAEILGELQVQLSEYKALKEQIDPSSLVSHQVPHAAVSVLKSAGQSSSAVSDMLAGGSSGSSTA

SEQ ID NO: 154 - protein, 1315 aa, Postia placenta Mad-698-R
IRIYRANGSYHVVRINLSVTVEQLAPMLGKRLLLDPEREPHRLYLRERGRERVLAPTERPANIVRRRLEQAGYDQADGLDVLGADDLAFLLRFVYKSEVLGPVADDLQIDQYDGIDLTGRSLRTVPVMLYPHAEAIVSLNLSRNPMLEIPLDFIQSCTTLRELRLSHMAMKKVPQSIRRCRTLHRLDLSCNRIVDLDDAGLDWIPELRSLKVQNNRMAGLPFYFPRLRALKELNISNNKFRELPAVVSEITNLVDLDISFNMIEKLPENTGELHALERLIIIGNQVTEFPASVADLANLQMLDCRRNNISDLSLVGVLPKIQQIVADHNSVHALDITFSSSLKHLDVSHNDITQLTVIPGPLRQPYALTHLDLSNGKLSALDEHALAQLTALETLRFDHNSIRYIPDSLGELSHLVHLSCSNNQLRALPETIGRLQKLETLEAHNNSLPELPATLWHCASLQLINATSNLLHSWRLPPLHSMNMSTNSSSGSLSARKMSSSGSVTTRVLPPLVFSLERLYLGENRLTDDTLHPLALLQELRVLNLSFNEIQEMPPSFFRNLSHLRELYLSGNKLSAIPTEDLPRLIKLEVLFLNGNRLQTLPKEIGKLTNLTVVDAGSNILKYNIFNWEFDWNWNFNTSLQYLNLSGNKRLEIRTDVAPVRDDEKRRVLADFSGLTQLRVLGLMDITATNGASIPDENEDRRVRTSLSEVNGMGYGIADTLGVTEHLNMLDLVQPQFRAKNDEAIFAMFGRASHIGNNHWLNNYLHSKFLEVYIIELNRIKPAVGEAVQDALRRAFLKLNRHLHDFLYASASNRKMSHVSTSTSNPRDMNKRSGASGIVLHLVGRKLYVANIGRSLAVISREGNATLLSRKHDPFDRQETSRIRSAEGWVSPKGLVNDEIDVARSFGFYNLLPVVNARPHISEYDLTEQDEFVIVGNSGLWDHVSYQTAVDIARTERGDPMIAAQKLRDLAISHGAEGTTMIMVIAVADLFGGPARSRQPTMESVIDTETYLWTKRRGRDNITNRDISRLEGEVPAPTGHVALVFTDIRNSTHLWEVNAGMPTAMVLHNNLLRRQLRFCGGYEVKTEGDAFMCSFPTAISALWFCFSVQVQLLQLDWPLEILECEDGKEIFDLEGKLIARGLSVRMGIHCGHPVCEPDPVTGRMDYFGPMVNRSARIESSAGGGQIMCSAEVVREIKARVFETDKPEVEQPYVRPSQAIDAIRRMGIEIVEVGEVKLKGLEVPEMLSLVYPQELAGRKTLTTTQSASNPSGSRVQFSVEQMRELALLCIRLEMLSSGNVVRSSRDRRSTSSSRST

SEQ ID NO: 155 - protein, 2159 aa, Talaromyces stipitatus ATCC 10500
MARRNGDLMSLNERHGSESSTSSYRSQSTVRDDTAANGLRNGNGNGRQTPSQSGLKRYPSGRQGDAPTPPELYTSMFSHSPSISPTDLRRPGPGVPNHRKALAILGADDYFSLNSAPPPPPPPASGSYQITLNPIAHDPFRASWAAPASPASPVPQDKTEPFHRNSGTFLQDASEHEVSPITPSFRPGSEATSDSDVHDFGYKEFRRESAASATSSNSKSSQNGHFRKRLHGFFGNGTGDENASAESSRREHSEPNTRNRETPVSRHRNDSTASKPLSESSKARTISPRPSRPLTPAPSSEVTPWIFQQYNDIPHYGEAPIRKEPTGPDSQRFTNGKAASINSDHKSSHKLPFPGRRHSRSKEGKPTSAGSYESTFRSTGSANPQDADAGSHIRDAGGLLASTAMSSTSTLAGRPTSPTPSAQSSIVQRDTGSGHDSPGPKRGFIRHWILGGSKSSNLKSLPGSEKNLHDAIRSAAKGPKRDTSPYRHRQGSLDDGVGRHGESLEYDRKKDGRGLGIRSHGVKKVRKHTANKSPTRREENYFPLDTNLDNMEGIVSGPRPLSPNNQPAIFDGTLGEDRPPQENQVGDWNAPDSWRVIERGDDVVRGLPEIDDELEAAAIHDSSSYFIRVFRIDSTFATLSAPLHATVSDILELLGKKSFLQDDLKNYEIVMRKNDLSRQLEHGERPILLQKRLLEQVGYLPKDRIEDVGREDHSYICRFIFLPTKLNSYVTLDADPGFNKSQKFSHVDLQGRSLATIPISLYKRAPEIISLNLSRNLDMDVPSDFITSCINLREIKFMSNEAWRLPASFRLATRLTYLDASNNRLDTLDHTDLSELHGLVSIKLANNKLSSLPNYFRDYSSLRSLTLSSNNFKIFPDFLCDLPNLVDLDISFNSIRELPHIGRLTQLERLWVTNNKLSGPLDKSFQGLKSIKEIDARFNDIENVDSIMQLPRLEQLLLGHNAVTRFRGSFPKLRTLVLDHCPITQFELDAPIQTLTSLNIASGKLVQLKDSTFENLPNLTKLILDKNFFSSLSTYIGKLRRLEHFSIIKNPLKSLPPTIGCLSELKHLNLRECNLERLPSEIWFCLKLEHLNVSSNILDGFPKHTGQPPVPPGEYISPSQATTPGLSNSPSYENMASLDEVQSRRPSQNSGGLLSLAGGSPSIGRNNSLQSNYVPGSRKASTASRAYTDGSGSTRKDSNFAQRLATTFSGSLRNLYLADNRLEDDVFRELAFLPELRVLNLSYNALTEVPQGYLKRWQNLTDIFLSGNELASLPSDDLEETSNLKTIHLNGNRFQVLPAELCKVSKLAILDVGSNLLKYNVSNWPYDWNWNWNRNLKYLNFSGNKRLEIKPNIASLGSNSVNGTDLTGFNSLTHLRILGLMDVTLTIKTVPEETEDRRVRTSASLAGSLAYGMADFLGKDEHLSIIDMMVPRLRSDNMDTLVGMFDGQSQSIGGSKIAKFLHENFTHCFVDELKKLSPDTDTPLDALRRTFLTLNKDMAGAAYKSIDDKEVRQFTRGSTAAKLLSKDDIHSGGVATVLYLRNMDLYVANVGDAQAVLVKSDGTIRPLTFNHDPAETGERNRIREAGGFVSRNGKLNDVLPVSRAFGYFPLIPSVVAAPHTAHFTLTEQDEMIIMASREVWDYITFDLVVDVARAERRDLMIASQKIRDLAIAFGASNKLMVMIVGVSELKKRERYRKLRNASLSVGPSSFPEEVLPPKRARRARDAVGDSRLARFNFVDAPVGDLAIIFTDIKKSTSLWETCPEAMRSAIQIHNDILRRQLGIVGGYEVKTEGDAFMVAFSTTSAALLWCFNCQTQLLEAEWPKEILEQPQCKERYDKDGNLIFRGLSVRMGTHWGEPVCEKDPVTNRMDYFGPMVNRASRISAVADGGQIFVSSDFMSELQRTSEVYAESERSLSVSSESDYGDPLQNIRRELQQLNSQGFIVKDQGEKKLKGLENPESVYLILPHSLSGRLAAQEGVSPDEDLAPATIKKGSQLDIRTDEIWQLWEITLRLERLCSSLEAPETSETTLPNRQLMGAIQRAGGELADATILSIVESQVTRIENCINTLAIRHMMHPFKQGGSLRDHAMTMAEVISQLQSQLAEFQALKDYLNTAATGAPDPAAIVGRDLKSPSSDSSRVNSNSSSHIRLLLSPPSPDR

SEQ ID NO: 156 - protein, 2145 aa, Podospora anserina
MPRNDASSRFSSMTGSSTDSARSNITVKPLPSLPPSASSSSPFAASSNQTSNASRSASHGSRRAAPSRLKTDENGQLSRSFKDSDAQVSPTSTSPCVSPSSITSSNSIREHRMSDLADYRRDLAILDPAGGRASRTQQNNPSSGSLSQIAPWMAAAPTPASSGPLPTSFFNDSTDNLSLSSQTSPGLRNATARPSQTTTGSTESPETLYFTDERRPSIASITTTASSQGSRASGARGGIRKLQGFFGEEFPGRDSSEISLSHPIVGKEHRSHSYSHARPHRDRNYSNATDHGRDASPASRPRTPVPKPEVVPFLYQEADDIARYGEAPVRDILSGPDRERFVNDSSQQNNPPKTSGSGRSGHSIGVHLTGHHHRHNKSNEDPRSLRPTVSREDSTISVPKDRNGSSTMYGTRSRAQSPAPSTTGSYWGHKSGSTDGQTSPGQPKKSFLGRLGRRLKEKDDAPDLKKLGPASQSSLHSRPSRQELSKADGQFARGADGKYQPDVRDGIRPDLARPANGPQTFNKFSLSKKAPRSKTQDDLDEAIGPTDRQDVGTVFHLDTNLNNMDGILSKPAPLTPMNAHEIFDEVGSGKGSISYPSSNGAWNAPDSWAVLRDDDAGAQLPDTEDIGSPPRPEEKQHNYCIRVFRADGTFATLQMPLLTSVSELINQIVKKSYLQDPDKFKLVLKKHDLYKVLQSTDRPLLLQKRLLEQVGFEERDRIEDIGREDNSYLCRFLFYPFTDNSYEVMDQMEFLRSQKNNHIDLSGRSLSAIPVQLYPRANEIISLNLSRNLSLQVPRDFISVCPNLRDIKFNNNEARALPKSFGYASRLTMLDASNNRLESLESAALHNLTGLLKLNLANNKLKQLPREFEAFAVLRTLNISSNLLNNFPPFLAKLENLVDLDLSFNTIQSLPDNVGQMTSLERLVITNNELSGSLPPSFKNLRSLRELDIKYNAISNIDVISQLPKLEILSATRNNISQFSGTFERVRSIKLNWNPITKFEIKAPVPTLKALNLSNAQLASIDESFHNMSNLERLELDKNYFVSLPAHIGNLRRLEYFSIAHNSVGELPPEIGCLTELKRLDVRGNNIRKLPMELWWANKLDYLNASSNVLENFPKPASRAPHPPGETNGNTSFPTGRIGPPTGALSQTPSAEELNDPSRRPSQASSSLLSVGPSPVPGGADRKSSMVSVYGKGGRKTSVISRSTTQSSTALATPTASSRKDSSHTQRLTNTFAGSLRYLYMADNQLDDDCFDQLCMLENLRVLNLSYNDLSDMPQRSIKSWPQLVELYLSGNELASLPADDLEEYSMLQTLHINGNKFTNLPADISRAKKLTVFDCGSNSLKYNIANVPYDWNWNLNPNLRYLNLSGNRRLEIKQSSVPTAAQNREQYTDFGRLTNLRVLGLMDVTVLNSTLPDQSEDRRVRTSGSLAGYMPYGMADTLGSKNEHLSTIDLVVPRFNSNDSETLLGLFDGQALSSGGSKIAKYLQENFGHIFSQELRDLKNTENPADALRRSFLSLNKDLIAAGNTHTEDRSLMVHRGSTAPLVLSREDMNSGGVATIVYIQNQDLYVANVGDVQAMIIKSDSTHVMLTKKHDPADPNERTRIREAGGWVSRNGRLNDLLEVSRAFGYLDLMPAVQSAPNIEKHTIGEHDEMILIATREVWEYLPKDVLVDVTRSVRQDPDPMRAAQKVRDLAMAYGCSNKMTVQMLGVSNLKARRERSRQHKGQSMPVYASLQDDGGSSTGMRRARKARDGPLDSTLGRLDAEVPAPTGLIAIVFTDIKNSTQLWETYPEAMRTAIKNHNELMRRQLRTIGGFEVKTEGDAFMVSFPTATSALLWCFAVQCKLLHLDWPAELYNSVNCQPVYDRDNNLIFKGLSVRMGIHWGEPLSEPDPVTRRMDYYGPMVNKASRISACADGGQIAVSSDFIAEIQRCLEHYQEPTSTAVDLNEDSFATAIRSELRSLSGQGFEVKDMGEKKLKGLENPEFIYSLYPHALSGRIETHSKHEKEQAQDLREIRPAILSPGSELSVEPDDIWSLWRVALRLEMLCSMLEDNSKALQPPETGLLDRMRQRGGEVSEDFLVNFLDHQVSRIETCINTIYMRHLVSQSSIGSNFGALRGPMDEVLKVVAEQFQLVAEYKARYGDLRA

SEQ ID NO: 157 - protein, 1641 aa, Komagataella pastoris GS115
MPMSITDNGLGNQHDPDHPGKQSLTPKYTKTRRILSKLRRTSSKTDDNDPRRVSVASHRYSLVPGPIHKKKDEKMEPHHHIHIHNPAVALKNVFQTPSPSVGDSRRRSTTEEPTTLSPTGSVEDLSAFISRKDDSDDEGDDANNNTLTKSFTGFNLNNLSDDDIPTNGNITHMSAWQPPQSWSVKASNMKEQEKSLTLSSTSSTDAESEQSSISSFGKKKDHVESEAIDPNCIHEPNTECPVHGHPHDMTVGDASNEEKKVSEPHHHLYHNQPLVGRLKVFKDNNGRTLNVTINENFRQIIKRLENGHWLNPNEDYRILLRCGGLHEVLSLDDHPLRIQERLLNLSGFTDPDDWKQLDMTYLYKFIFEYNEEKGLNPSIKSRISVRYGRADLKNLDLRTIPNTIHQQAEDIIYLDVSKNPSIFIPLDFIQGCRNTQTLKFTGNRAHSLHKNIFQFANLRNLDLETNYLRQIPKDITLLSTLTNLEISNNRITQLPSNFGELALLRYLNLSSNHIKVIPQEIFDLPNLTELDLSYNSISNIPVEIKNLTKLVTLKLSGNKLAGKVSDSIVEVKSIKTLDLRFNQLEDMSCLRTLDNLQNLYLTGNLCTSYTSKVASLRTLQLDLNPVTHFSVIGTLESLRYLDLTKAKLTSLSPSVLSNVPQVTHLILNHNHLSFLPKEISTLKKLKKLSVCNNNLTTLPDEISELQELTSLDLHLNNIKTLPITIWQLNLRELILSSNSLPDTPALTGENKLGNSLLILSLSHNRLRNRYLSNLINFKNLRSLNISYNGIYDLTNGSLGHLKNLTHLYLSGNELTILPDDLESLTNLTVLHLNGNRFQSLPYELSKIPRLSVLDVGSNILKYDISDSPRYWNWNMNKELKYLNFSGNKSLKISSTTSTSKDMGEKTTSKFGSLQDLCILGLVDVTWNDTIENSIKTRVRSTPSTFGGYGYGISDTLGRNSSLTTRDCVVEKFREKEDETLICLFDGKNNDVHVTKVLEEVFKNFLETQLDAIDSKMASGTPVDALRRAFLQCNQEINTLIDDPSTGNVDPSHFPGQTKEYLARSGGKTGCSGTVILIQGRKIHVANVGDTLSIKTTSTGEFDVLTQKHEPYEPSEYKRIRASGGFVTTEGKVNDVVDISRAFGFWNLVPTVNAAPKISQFELKATDGAIVLATKELWKLISMDLAFDIIRNDVNNPMIAAETLRDYAISYGCSGNITVIVISLRYKQMVANNQTTRDVLRQEYSNLIKLEDEIYPPVGNVAMVFTDIKNSTKLWETNPISMRTAIKLHNSIMRRQLKIVGGYEVKTEGDAFMVAFPTPTSALLWCFSVQKQLLHESWPEEIIKSPHCARVQDKYGNDLFRGLSVRMGIHWGSPVCEADLITRRMDYFGPMVNLASRVSGVADGGHIALSSQFIHEFEKLDESHEKLKSFTGERFGDQWKQTVAEAYGTDASYACQIESEFEQLEVDKWVFFVIGERKLKGLENPEKICLGYPGSLAERIDCTEQKMDKDEMVATQVVRDRDYGIMGIIAARDIWKLRRIAFRLEHILTVLQSGRVFNDTSSIITDQISMVMTSKLGDEDYFSLLEHVITRIENISNNLALRQETDIALGNDGRLTVLTNEEFMSALSACLHEFKRLKHWET

SEQ ID NO: 158 - protein, 2157 aa, Zygosaccharomyces rouxii
MFRRGDKSQDAGKKQHRVDTPLARSTSSVSMDSKDLRSTSSRTHGSKRLGDSDDGAVDRPRARSNPNEKGITRGAWAEPESIAPSGEKSINTGGIGGVGGNLDTSHLNTQQQQPRYKTKDSRIRKGPELFKKTLSSLSLSSAASEDDAMPSPQDQTHSQHHQDSQQQQQQQQQQQQPIHTTSSATSDGNVRTHPHSRHGSQNEGAIAPPSRKHSLAGSFFKKLSGAGNSDGESNGKDSSSPHNHKQGYFRSVHPHGGLHTSFYNNIASAAGGIRDTRDTGSNTGASSGTGCTNGSNAGPDGNTTETVPNSLRRKVSTLVHGFGHESEQPSSHSGRRPLHHDKNKGNKRESDNISMVSSARPRLSATSSRRNSATSTFTNNSTAPVQPRSPSLKRESPPKEPAGHLNSTSSAPPAASSGASGASGSGAGSFFPLDTNLENVSDITKAPELSRRPSAAYEGYHNPNDNRASISGAPSQSVTHVNSNSDIAALPTSMTMNSNPLSARQQWIAPESWDVDSNVDIRRAKKHNKSVLLQEQLASQRRLKQQHGQQQPQLPSQPEVQQNHQQQQQQQQQQQQFGKFGDAYFEVPNQNEFTSGISSTNDSDNSSLVDFSDSSSSDLDYASDVENYLEQSADKKTDAGGGSPQLPPDFEQQLQQQKQEVQPPPLKLNYNTGLNSSGDARQSLGEALNQSPQDMKYYEGLRQQEKRQEAEGVQWNQGMLHEKQMNQQHQLKDQPQGQLQQQNQQQELAPGKGPFNDLQANLRQPSNPPKTLSKVLGAGTRDQEVMKLSSDDEKHDRVEYELERYYKDFSDLNPKRHYAIRIFNTDDTFTTLSCTPATTVRDILPSLKRKFNVTSQGSFQISLKVGKLCKILRPLSKPIIIERKLLLLNGYKKTDPLHIMGIEDLSFVFKFLFHPVAPSHLTPGQEQRLMRGDFIHVDLRGMDLTTPPIIFYQHTSEIESLDVSNNANIFLPVEFIESATKLSSLRMVNIRASKFPINICDVDELVSLELQRNFIRRVPHAISQLANLTILNLQCNELDKLPRGFSQLKNLQLLDLSSNRFVHYPEVVNECSNLLQINLSYNKIHTLPPTTNKLVKLAKMNISHNKLALIPNLSGMKNLRTLNSQHNRVARIKTGAPNLQNLSLTDNRISTFDDVLPKLKTLELQENPITSISYSGFSSMNMTSLSLSKAKLSSLPDELFVELRCLEKLDLSENNLTKLPEGFCQLNKLVHLSVARNKLQKLPKDFHNLKNLKTLDLHSNNIRDFATGMEDLDLTFVNISSNMFGNSCLMGQFCQNISADRRLSKSLEFLVAADNQFNDQMWPFFNCLTNLKVLNLSYNNFQDISNLKLENLSGLYFSGNKLATVSGDVVLKWKNLRTLMLNGNYLLSLPAELSQLTDLRVFDVGSNQLKYNISNYHYDWNWRENKQLKYLNFSGNRRFEIKSSVNHDIKTDFSDLTVLPNLKVLGLMDVTLNTTKVPDENINFRLRTSGSIINGMRYGVADTLGKREFVSSRDVTFERFGGKDDECLLCLHDGKNQYADYGHNIARLVRDIYDKILLRQLEKYGDSDMGIRKALRFSFLQLNKEVNGMLSHVDDGSAMANLSSADLLSGACSTVVYIRGNQIYTANIGDCMAILSKTNGDFQKLTCLHVPYKREEYERIRISGGYVNDYKLDGVVDVSRAVGFFDLLPHIHASPDISMVQLTKADEMLVIATHKLWQYMDFETACDIARENSSQPMLAAEAMKDHAIAYGCSDNLTIMCLSLHKDDEQQNRFTLNRNSLITRRSTFEDATLRRLQPEISPPTGNLAIVFTDIKSSTFLWEMFPNAMRTAIKTHNDIMRRLLRIYGGYEVKTEGDAFMVAFPTPISALVWCMSVQLKFVEAQWPEEITSIQDGCLVIDKLGNKIYQGLSVRMGVHWGCPVPELDLVTQRMDYLGPMVNKAARVEGVADGGQITLSSDFLSEFNKIMNFHETVVKDKCPLKEVYGEEFVGEVLEKEISMLESIGWEFFDHGEQKLKGLETKELITIAYPKSLVSRHNFITKDEEARLLNEEFISRLRSVSRRVESVLSAVSKGSVDEHRKPGRLSSIDENVKSSVRFLNSEKDATAFFDDLITRLESYIALLKLHQVVHKGLRVNDQSAQELGTNIFDLLDAVLEKIQ

SEQ ID NO: 159 - protein, 1890 aa, Lachancea thermotolerans
MSEQTRRRANSLEAEKSFQVPEDAAEAGASGGLHGRPHFRKQYSVGGFGPTFSGGASGASGGIAGAGSASAQGHGARGRAAKALGKGRYKGFHNPVALHSPDDPIPPYAHPIKPRIPGLNRTISGNSLFSSSQAARDPQQLQHQQQQQQRKGSRAGSLFKRLTGMKMTNASASEPSDQESAAANPTAGPAGIRRKMSTLIHGGSGAGSGQAQDAGHVSGSDLNSKTSKSGFLNTPSSTNSRRGSAASIITSPSGNNSPKISHISNSNVNNALSATSASASANDSGNQVSDSSESPGRNALNRSTSYFLLDTDLNNLSDITNISDKKPKEKAKLPPKSRSQTPVAKVQPQDIGKAPLVDTETSAPHEAAHSKVQWIAPESWDIDEEVGKPLPGKKNKRRVHRHHTSNTTSKIDRERAGGATKKPGRPKQKENTPKLGSLKEVTDQEHNHLSTTAQEDTKESSGSAASISSAASRSQEFSEAASSTSDYEDDYGDESHWRAGSLDSLQTYDSDQAKNDEAFDRVGYELDKYYNDFSDIDPTRRYAIRVFNTDETFTTLSLTPNTTVQEMIPQLKRKFNIGQGNYQVSLKVAKILKVLRPTARPILIQRKLLLLNGYQKGDPLHILGIEDLSYVFNFIFHPVATSHLSYEEEQRLTRGDFIHVDLRSMNLTTPPIIFYQYTPNIESLDVSNNANIFLPLDFIESASKLSSLRMVNIRASRFPPNITEAHVLVSLDLERNFIERIPPSISNLSELTILNLQCNELDRLPTGFTELKNLRLLDISSNNFAQYPEVINHCTNLLQVDLSYNKIQTLPDSINRLTKLAKMNLSNNKLTNIGSLSGMVNLRTLNLKDNRITSLKLENSNLQNLSISNNRISVFDDKLPKLKSLEIHENPITSISYDGEYLVNIVTLSLNKAKLASLPPELLCKLPRLEKLELNGNNLTQIPPEISKLTKLVYLSAARNKLESISEDITELRNLKTLDIHSNNLSNLVKGLGKMELINFNVSSNLLGNTMDIQEVFLNRRDSVLAKSLRFLSMADNNLGDQFWTLFNMYENLKTLNLSYNNLSDLSNFKLENLTELYLSGNKFITLQGDTVLRWKSLKVLMLNGNNLLSLPSELSQLTQLNVLDVGSNQLKYNISNYHYDWNWNNNKNLKYLNFSGNKRFEIKSTAALDSESKADLSDLTILKELRILGLMDVTLKTSKVPDEGVNMRLRTTASVLNGMKYGVADTLGLKDSVTSRDVTFERFRGKEDECLVCLFDGKNENVSTGHNISKIIRDIYHKILIRQLEKYGDTAEGIKNALRFSFLQLNKEINSTLNSVDNEATSEDFSSADLLSGSSATVLYMKGKRLYTANIGDTMAILSKNNGDVVPLTKLHVPSKREEYERIRISGGYVNNYKLDGVSDVSRAVGFFDLLPHIHASPDLSEFNLTTTDDLVIIATAKLWDYLDYQTACDICRENKVEPMLAAEKLKDYAISFGCAANMTILCISLDKSSSNQNNFMLNKNDLISRRSTFEDSTLRRLQPEISPPTGNLAMVFTDIKNSTFLWESFPNAMRSAIKTHNDIMRRNLRIFGGYEVKTEGDAFMVAFPTPISALVWCMSVQLKLLEAEWPEEITSIQGGCLITDNEDRKIYLGLSVRMGIHWGCPVPELDVVTQRMDYLGPVVNKASRVSGIADGGQITLSSDFCSEFNKILGLHERVVKENAPLKEVYGEEFVGEIMEREVHLLESIGWEFRELGEKKLKGLETKEFITIAYPKALEARHGFTTRDAETSLVDEETLFQLRAVSTKLESLVSVLNGVMLEKKEYSEAGSYVNLDKKQISAVSHSTTEGDRIALLDHIITRLESIVATLQIRQRVEGALEPPKIGDAGGERSIFEIVDQLLLETGRLTDSRK

SEQ ID NO: 160 - protein, 1709 aa, Candida tropicalis MYA-3404
MSFLRRDKSKANLRDGISTSSSSAGLDEPPISPNTHFPSVLPSFDGHLHHHGTNNPDHGYHDPDSPRSSVISLPQLMHNATPNHLKENYKGFHANKRPKGIGNVPPLAQPIKPRFKRKSNSLLNKIMNSGKREEDGKESASNSRSSSIIPEEKRRSASSISSSSSKHKFRFSSFDSNLSSTSTTPPREKDKEKQSSISEASDTTSIHSSTVPAISLDLNMDEIQDIVKTPPQQQQQDTLSTVKTNTSVTNIKNWQAPDSWDVKAVSKMEEHHAAQSPQPPVANKIEEIDTDDAEQELGTKRQPMLYGTHQVPHIANSLDTKSSHIIRVFKEDNTFTTVLCPLETTTSELLAIVQKKFFLESTANFQISVYIGNCIKVLEDFEKPLKIQMGLLLLSGYTEDDKLRMLGREDLSFVCKFVVENIFLRSLTHDEEVLLSRNYVDVNISSLNLKNIPIIFHQHTYEIEKLNVSNNPSIYLPLDFIQNCTNLAYVDFSHNGCSKFPMNLLEAPQLTHVNLEMNFLDDIPTSFNTLTNLTHLKLNSNQLSALPESFGTLSNLKVLNLSSNYFQTYPEPVNKLVNLIDLDLSYNDLADIPESITNLQSLQKLNLCTNVLSGSLPEYLSQLVSLKRLDIRYNYISNVGVLGKIPNLEVAYASKNKISTFNDQMKCLRLLHFDRNPITELKFNNEMEMLTVLDLSLAKITGIPPEFIDKIPSIEKLVLDKNHLVTLPNELSKLSKLSSLSIYSNNLQNLPSGIGELKHLKFLDLHSNNLKSLPDQIWELRSLSSLNVASNILTSFPKAPFSVVKKLSSSTDLRGELTQTSSLADSLHSLILSDNRLGDECFDEISFLVGLKTLNLSYNDLIEIPQGCICRLTRLNELYLSGNELSTLPGEDLEALKSLKLLYLNNNKLVTLPAELSKLANLQHLDVSSNQLKYNIANWPYDWNWHWNKNLRYLNFSGNKRFEIKQSHIKNPETGEDFDSLLVLKQLKVLGLIDVTLTTTNVPEQSIDLRLRTTASEFDNFGYGVSDSLGMRDHVSTRDLFVQKFRGNENEVLLCSFDGKHGAPNQGHRISLVSKNIFVNNFTKELDEIKSDDEIENALRKAFLAFNKEINGILSSKKNNAFTPIPKISKESLDLNLADDANAGCAVSVIYIKDKVMYSANIGDIEALLCRSNGDQFLLTTKHQPTTREEFERIRASGGYVSGQGELDDELAISRGVGFFNFLPHTNCAPSINKFKITVEDDLIILASKELWDYISYESAVDIIRKDKNDPMVAAQKLRDFAICYGSSDKIAVIVLTFGNRQKEVATMFSNYGVDRRRRDKQQLAGGDSNLRKLEQEIEPPIGSLALVFTDIKNSTLLWDSYPAPMRSAIKIHNNIMRRQLRISGGYEVKTEGDAFMVAFPSPTSALLWCFSVQQNLVSADWPSEILETDQCCTVTDADNNEIYRGLSVRMGIHWGSPVCEPDVITGRMDYFGPMVNRASRISSVADGGQIAVSSDFLDQMKSLTTKHNNIKNNVESVTEAYEGNPAAGALIERELNALEELGCNYYNIGERKLKGLETPEPITLVYTNRLKLRYEIFKKRFDETHSTRIVGTLPVEIIYGLRTVSLRLENVCSAINSGGKCAQESFETHSSGFISQKMSSTFKDADLISLLNHITTRIESCTATLGLRQQMSVHKGNHGYIDTMNSCSISELVDEINDILKTFNELSR

SEQ ID NO: 161 - protein, 2120 aa, Penicillium chrysogenum Wisconsin 54-1255
MPARDRNQPDNRQGSESSGKSWMSQDTVRNSESQPGDQDEAFAGGRNADQFPSSLKMDSKPDSSKPPRIDWGNSMWSWNSGNSPSEQRKASGFSNHREGLTVPGNRDSPSQSSVSGPRPPPLRPSRADSDEIESIAPWSTTPSSGQPDASGTFYHDSEHEASPASFTFRPTTGRTIASEPAEYEYHGEHRRPSAASATTVSSQGSRSSISQKFRKKHLKGLLGDDYHSPGELQTDDDGSQNPPSRRGGPVDQLKARERANSDGSRNTPEGSSSSQRPQRSRANNPLPSSDITPWDYQSFNDIPQYGEAPVRHVPIGPDGQRLPSSENGSSGQREPSRRGPGRHRSSRSKEENRTLAGDLAWSQPRPATGRDDIGLRPFNENYLHSGTDMSDSTPAGGRSTSPTPSVRSAYRDPDQNSQHPRIGGFIKKILGKSHSHDKSRNSSPPRRDRQPSVEGGTSSRYPESVDSDRKKDSGKGLMVGRKLGNRRVFTHQGGDIYNPKDDKNQEENKHFFHLDVDMENLKGIVRPPSPGQTKRGRDGTTTPLDDSKMEKPWNAPESWQVRGPIDPTLEDPTLEEPTPVGPRDREASYFIRIFRIDSTFATLSAGLNATVSEILLMLGRKSFLQDHLNNYEIVLRKHDLSRQLDHNERPIQMQKRLLEQVGYTQKDRIGDIGREDHSYLCRFIFLPTKLSGYSSLDAEPGFNKVQKFSHVDLQGRSLVTIPITLYAKSSEIISLNLSRNLSLDVPKDFIQSCINLREIKFIGNEAAFLPQSFGLASRLTYLDVSNNCLEDLDHAGLDRLTGLVSIKMANNQLTKLPSSFGNFQNLRSLNMSSNGFKVFPDFLCNLKSLVDLDISFNGIEELPNIGRLATLERLWMTNNNLSGPLDDSFRELVNLKEFDGRFNAISNIDALSSLPRLEQIFFGHNLLSRFKGSFPRLRSLHLDHCPLTHFDVDAPMPTLTSLNLASGKLSQFRDTIFENCPNITKLVLDKNHISSVSPQIGRLRRLEHFSMIKNPLSSLPPTLGCLAELKHLNLRECNLNSLPSEIWHCAKLEILNISSNILTSFPKCGAPYPQIPGEPTNTPGTTPGIAGNPSYEDVGPMNEPGLRRPSQTSNGVLHSVSPNGYRSPSTAQSGRKVSGTSPSYTDPNSVSRKDSNFSQQMAMTFAASLRTLSLADNRLEDDVFRELSLLPELRIVNLSYNDLTELPQGILKRWPLISELYLSGNELTSLPSDDLEEGSNLKVLHINANRFQVLPAELCKVSKLSILDVGSNGLKYNVSNWPYDWNWNWNRNLKYLNFSGNKRLEIKPNIASLGPPAANGADLTDFNSLTHLRVLGLMDVTLTIPTIPEETEDRRVRTSASLAGTLAYGMADSLGKTEHLSIIDMIVPRLKQDNVETLVGMFDGQTLSSGGSRVAKYLHENFTSTFSFELKKLQRDQGETPLDALRRSFLALNKNMAGSAYRSIDDREIRQYHRGSNAAKMLNQDDIQSGGVATVLYLNNMDLYAANVGDAQAILIRSDGSMVSLAQNHDPAEPNERARIRAAGGFVSRTGKLNDVLTVSRCFGHFPMMPAVIAAPSTMHTVLTEQDEMIVLASKELWDYVTPEVVVDITRREQPDLMFAAQKLRDLAISFGATNKLMVMILGVGEIRRRRPKPRPSLNTASSTFAEEQIIPTAKRPKKRDGPGDSRLARFEHVNAPEGELTIMFTDIKKSTGLWEICPDAMRSAIQIHNDILRRQLAIFGGYEVKTEGDAFMVAFSTTTAALLWCFNCQNQLLEAEWPTEILDQPQCRVVVDMDNNVIFRGLSVRMGGHWGEPVCAKDPVTSRMDYFGPMVNRASRISAVADGGQIFVSSDFMTDIHRSLEIFADAERSASTSSTDSSSRGDSLGHNIRRELQQLNSQGFVIKDQGERKLKGLENPEPLYLVYPSSLSGRMISSEESQDQDSSVATINPDNQLDIQTNVIWRLWEVTLRLERLCGAMEHPSEPSLREPNVALFNMVKRHGGELNDSTVLSLVDQQVTRIEVCINTLSLRHMMRPFKPGDTLSDHAVPISEVLQQLQTQLAEFQALKEQMAVDAAGNIGGPPTPVKMGPSGSIDSGITSASSSFLHLPGDANRSFDSGRS

SEQ ID NO: 162 - protein, 2075 aa, Uncinocarpus reesii 1704
MASRQRERYQAVRHGSESSSTGSRHSHDTLRQNNRSSGAGRSLPSQGQMGTENRSQSSSRRPSSVFDDVPHVPYLSESSDVSPTDRRSSYGFRNHRKALARLDTPDYPASKMSRNNPPTINPRPPPSLHPVPPSPSSPLPPTSANQGTFFNDSSEFETSPSLRPATAQSVVSNSPDLGYDNDGRRPSIASVATGSSGGSRSTGSARFHKRLQGFFGDEYQDGVSMERSISNRVPSIAPSRDRHNSLNSSNALERRPSPNLSAPRTPLPSSEVTPWEFQDFTDIPHLGDAPVREEPTNPNGRYPPSSSTIKPKHRLHFGHRHNRSKEDQASAASSQQSASRENLNHPRPSKDQPLGTSTPMSMSTTTLAGRSTSPTPSAQSINQGQMSPSVPTPKRSFFDKIRRPKGHHPSALLKHFPTSSSILQEPLKGPKRLKAEMSPASRSRNGSGEATVPGGQWEYIDYDRKKEPSSKGGPSKLRHGRLPFGHDGGSSKDPFKQERETFQGEHVYLDTNLGDMEGIIRQPRPGSPTDTGDIFTGADYGTAKSESRTVLDKPTAGDWHAPDSWAVKKPSDDIVSRLPELAEDDASLSVDEDGHPYCVRVFRIDSTFATLSAGLNTTVTEILEMLGRKSFLQDDLNNYDIVMRKNDLSRRLDQGERPILMQKRLLEQVGYQNSDRIADIGREDNSYLVRFTFLPTKLGIYSSLDSELAFNENQKFSHLDLQSKNLVTIPIKLYKKAPEIISLNLSRNLALDVPKDFIQSCINLRDIQFMSNEAWRLPASFGLATRLTYLDISNNCLEQLEHAELHNLHGLISLKMANNKLSSLPSYFGDFPALRHLNISSNNFQYFPEFLCKLTSLVHLDISFNQITELATIGQLRSLERLWVTNNTLSGPLGETFRHLVNLKEMDARFNDITGIDNLTQLPRLETLLIGHNSVSTFYGSFTKLRTLVLDHCPVTDFHLTAPVPTLQSLNIASAKLVQFKDSLFTNMPNLMKLFLNKNHFVTLSPYIGHLRRLEHFSIAKNPLSQLPPTIGCLTELRSLNLRECNLKKLPAEIWYCLRLEVLNISSNVLDTFPKPATSPPKLPTAEVQANGTGTPMSTPGLSSSASYEELGKLEGFETRRPSQASGGYLSAGSPPADATRKLSVSSLSGRQQAAASRPGAEAFRKDSTYSQKMLNTFGGSLRQLYLADNRLEDDIFHQLVLLPELRILNLSYNELTELPPGVLRRLQFLSELHLSGNELSTLPSDDLEESSNLKTLYINANKFQVLPAELCKINKLAVLDVGSNSLKYNVSNFPYDWNWNWNHNLRYLNFSGNKRFEIKPSSSYASGVGNINGTDLTNFNSLNYIRVLGLMDVTLTIRNVPEETEDRRVRTSASASGSISYGVADTLGKNEHLSMIDMVVPRFRGNPMETIIGLFDGNTSLSGGSRIAKYLHENFPAAFANENASDALRRSFLALNKDLATAAHKSMDDRESRHWDRASGIGKILNQDDIRSGAVATILYIRNMDLFVANVGNAQAVLVQSNGQHKFLTRNHDPAEKSERQRIRTAGGFVSRNGKLNDRLSVSRAFGFFHLIPAVMAAPDTLKVTLTAQDEMIILASGELWDYVTPDVVTTSILLTSKRVKRPRDAPSDSRLARLDRVEAPTGELAIVFTDIKKSTSLWETYPIAMRSAIQIHNELFRRQLSLTGGFEVKTEGDAFMVSFSTVTAALLWCFTCQTQLLDAPWPTEILEAPACQERFDADGNRIYRGLSVRMGMHWGQPVCERDPVTGRMDYFGPMVNRASRISAVADGGQIFVSSDFVAEIQRTLEAFADFERSSSTGSEDTFPDDLLNNSIRNDLYQLSTQGFEVKDLGERKLKGLENPEFVYLMYPHSLAGRLAYQPDLSEERVEMPVPGTLGRNSKLNIEADQFWRLMKIGLRLEAFCSALENPSASTLIEPDINLINALKARGGEITDSSVLNLLEHQVARIETCTNTLSIRHMMRPFKPGDTLEDHAVPMIDIIRQLQVQLAEFKALKEQINIVNPSISVPPPSTASSGTPLRRAVFLGSERASSTPTIVDLGGEGYADDEDTTEFEPV

SEQ ID NO: 163 - protein, 1855 aa, Clavispora lusitaniae ATCC 42720
MSFLKRDKSRTSLRFPGLAAGQSDSRPTFGLRRAHTERPKESHLWDFHERETEGPEKEDQGADGEDEKEDGARLDRWPGETENMDERKNAGGNERDGDENHEPENTEQTDEADKTDKDKTDKTDKTDKTDKTDKLESVQSRGSQSEPNHASQSEYHESQSEHNDYEQNQNNQNNQNNQNSQNTSVSQNHESQNLSVDPYADARSLHSTHSTHSDTHGEPRDRRDPPRVVRDDYRGFHRSGVHAIVPPLAHPIKPSFRKRGSGLLGKWMHQRPGGNASSASSMAGEPDRAKHKFRLPSISSHHVSSSSSRPPSSDESDRRSSVQSGRGSVSGPHLSAGGMFDLDLSAADLSAIVKKPASARPSLAKTASAGSMEEDRHAWKAPDSWDVTEETPRDASDVSSSASASAEASRRSSEVADARRGDSRPSFPVRSLPVLFGSVAGRTGNAGGPNHIIRVFKEDNTFTTILCPVDTSTADLLSIVQRKFFLESISNYRLALYVANNTKVLEPFEKPLRIQMGLLALSGYSESDNLRMIGREDMSFVCKFVVENMFLRNLTHEEESLLSKDYVDVNISNLKLKTIPIIFHQHTYEIEKLNVSNNPAIHIPLDFIQSCTNLSSISFAHNGCSKFPTNFLEATNLVSLDIGSNFLDEIPPRFNCLQHLQHLKLNSNQLYFLPSTFGTLSNLVSLNLSSNYFQVYPECLSDLVNLQDLDLSYNDLSTIPSSISNMTKLTKLNLCTNKLSGKLPDCFKNLSNLKRLDIRYNKITNVDVLGSLPNLEVLYASKNNIAGFSDKMESLRLLHFDRNPITNLEFQITLPRLTVLDLSKAKITALPGEFISKMPHIEKLVLDKNHLVTLPDELSALPRLTHLSLYANNLQHLPDSIGQLVSLQYLDLHSNNIETLPSSIWNLKSLSTLNVSSNMLSSFPSPSLELASKMSSPKTGNDSAGKSNQNQVMASSAQFNSLADSLLSLTLADNRLNDDCYEAISLLVNLKQLNISYNDLLEIPDGALTRLTKLTELYLSGNNFVKLPVEDVEDLADLRLLYVNNNKLTSLPSELSKLKNLMHFDVGSNHLRYNISNWPYDWNWCWNKKLKYLNFSGNKRFEIKQSHLKNPDTGEDFDSLLVLKDLKVLGLIDVTLTTPSVPDQSVDKRVRTTASELDNVGYGVSDTMGIRDCVSFRDVFIQKFRGNENEVLLCSFDGKLSKPQTKGHLISYLAKQIFVHNFTAELNKIKSDDDIHDAMRRAFLSLNKEINSALAAKKGGYFTNNPTWPELSNLDLEDDGLAGCAMSVLYLKDHMLYCGNVGDTEVVLTKNNDEHQILSTKHDPTSRHEFERIRSSGGYVSGDGALDGALKVSRGVGFFNYVPHTNSCPSLTTVKLSGMDDLIIVASKILWDYLTYDLAVDIVRQEKDDLMIAAQKLRDYAICYGATDKISVTVICVGDQRKKRKNMGSMFKNLGRDVEFFANKKRRDRGAPAGDTALRRLDSEIDPPVGELALVFTDIKNSTLLWDAYPVAMRSAIKLHNTIMRRQLRIVGGYEVKTEGDSFMVSFPTPTSALLWCFNVQNQLLNEDWPTEVLETNECCEVTDNAGNIIYRGLSVRMGIHWGSPVCELDMVTRRMDYFGPMVNRTSRIESSADGGQIAVSSDFLRELKQLFKLHDEIQSKKLTLEDAYEGNVGVGQIIEKEIASLDAKGYSFFELGERKLKGLETPEMITLAFSKNLEIRYEIFKEKANRSTEYPTRIIGALPVDAVYRLRTISLRLENICSALSSGLNNDETFSQSSSDVISRKVGSDFLERDIVGLFNHIVTRVENCVATIELRQSLQTFRGEPYFDRRSVWELMDEVKQLLAQMPQQNAIL

SEQ ID NO: 164 - protein, 1813 aa, Naegleria gruberi
MRNGILAAFHEINSIGGVWGSKKLKLLSLDDNYDPVSTLQNTNYFLYNITPPNTSLNYANVFSSGKYEDRNVNDVKVFGLLGYVGTPTVQAVYSDVVAKNVPLVASFTGVGWLRYSPFYSNVINLRASYDDETAAMIDYLINEKLIRRISVFYQNDSFGLAGLSGVQRSLVNYLNIPIRSTSYYTRGTLNVENAFQEIGAGKPAAIICIGTFAPIAKFIKMVKDLAFNSTANQYGYEKPSEIIFMTLSFVSSGALIERLNSFSLPSNNYGNSYYIDNVVITQVVPSPFNLSIPIVRSYQNARRSYLLANDPSSYNSFTPSFIELEGYMAGRLVFSIFQKMVGNLTRSNFIATNYFGGNRLGTDIGDSSSTGDSSGGVSLVDGIRVGPYRWCESVNVMDLNLPYADKISLNVSALSNTTCSNFNCNQGLKVVYKSSAQIENSKISFSILGNSFSWYDYKGGIYCISDPSLVKKPLIFGQSIYSNKDYTEELMLRKGILMAFTIYNQGLSSSDSKLELLTQYHSNKDELISNTKEFIETHDALALVGYSTDHFSLVESSGKINIATNPQFANISLIGGASTINSMKLRNPFTRNIIHAHSSIFEQLATIVEYSMNQEASSRFSIIYSKRNEDSFAAFGLLNQILTALGLVLDSSACIDGSNSYSYASIDSIVDSLRYNGSNPQVVIFAFPSNVDVVSSLIGAFQTTYQNSPKFGRNLDIVLMNSFFSLNAEYEMKDWLAQNYKSFFKVSFVSHLDSVYSSSQLSIVKFIQTMKNFFPNDYSNSTTLYHNKVLEGFYIGNLITSILINIDSGLTSKEVLQTIYDVKSFISQQTTYGPFSEDGCNVGIRQNYVFTFVSNSFSKVYTKSYDSGCGLLASSVETAIKSYINTPLLFGYLAPYRKIGNSQIERQLDLLSQVSDLDTSGHTQFSKGLSTYFKKITQKFNNGYSSKNIQLVIEYYSTDEEKFNLPNKVNSLIDKNRVFAIIGSEFIFTSSDISREFDSIRSTLETKQIPWINSYSGSMELRKPYTPYFVNVGPSVVDQAISFFNYFKQNGTVNLALVYENDPFYTNMAISEIVEYCRIESIPISFTQGVYNTSIADQIISLFSNARIEKDVAIMVLARDSNSASIIKHSILAAQKLNIDKKLYFGILIENSGRIFEQSLVSTSDLSYWISSISGSSLSTLSQSVLNGVKEGKLVMASSMDSPFHDFSGSDSASFVQLFKTETISYFDSNINHLTFEGYSLGHFIDILITSIEQAKSISGQTSNITPSDLLNSIYSNTVFDLNMKKVGPVGYACSNTTTASTTCDSSTSLGCSCNEGAKKVVLSTLTSQPTVNSSALFKYSNTISTNTFGTCGLVAVVPSLSVVAIVMIVLSGIAFLLLITIIPILSYRYYVARNAIKHAPKSKNGKLACCFTDIQNSTVLWQSNEKAMREALIIHNQIMRKNLDLCNGFEVKTQGDSFFVVFKNPTDALDWCVSVQHDLLTAKWPSDLLGLWDCRPEWDNATKEIIWSGVRVRMGLHYGAAEYVFDKVVKRPDYFGTCVNTSARVESVAIGGQILVSEDFLLETWKTNKCRLYSFIKFLQGNNNSYVSEIMTGLTLQEEQNDKDIVSVGGSSHKSSELSRNSISSRNSSVSSAQAYDLSDPNQVTKRKRTRHARGWRYLAEDMGEFTLKGLEGTTRLFQIKSTIMAKRNYPALKSVTVASSSKPLLLSQQSAAVFGLNGQSSSNSVTQDSKAFRTLMTRTNTQSFRTVPDQQIYQSYQEDGMEKGPQSIPPQSTVANPEIPMDSDFEVSRFKKNRIVPVITTTSENETNEEE

SEQ ID NO: 165 - protein, 1711 aa, Naegleria gruberi
MKVLSPLQLISIISCFVLFLFITTNALINPSNPSSDTTTWDLDNEIWFAQSAPLTGPSKRLGIEMRDGILTAFNEFNALGGVFGGKKLKLLTLDDAYEPTNTKVNTNLLLYNITPPNTSTLNQAIFNNSIALDEVKGRKYFGLIGFVGTPTVQNVFTDVLSQVWPLIGSFTGVGWLRTPFYPNIINIRASYDDETAAMVEWLVNVKLIRRISIMYQNDAFGNAGLSGINRSLVKRLNISLCSSGTFPRNTLQVEDAFNTIGKCNPEAIVLIGTYAPLSKYIRLVKDVAFSPYNSTLGYSKANQITFLTVSFVGSSALTEDLSSYQPPSLAYGKTYYTDNVVISQVVPSPMDTSYPIVSSYQRSRKEYAKNLGLDPSLVSFTFIELEGYLVGKLVFTVLKNMIGSLTRSNFIASIYFDFTSGVSDVTNAGGYFNFESVQVGRYKYCNAVNLYDHFLSPSNQTVVSGSCSDNCNQGLKIIYLSNIELKNNTNIRFNIFRDFSWYDTQKCISDTAQIQKQIIIGQSILSTSLRDQFITVGINAALSKRNSNYTRNIELKTLYHDDSASMLKNVVELKTLHESVAFVGVSAESINLDSSNTNSTIDIRGYSEFSNIPLFGVRSTNSMVLRNTFVSSFIHVFPSIMDQLGTVIDYSMKNGENRISIVYSSSNSNSVEVRQLLKSILDSIGIETDSEVDATETISLDSIINQLSSNTANPHSIFLTLSNPDQILSIISQIKKTYSNSSPLFRKGLSVYLINSLFDSSVEAIFSTPLSLIVDENLSVKYVSHLPGSYNSTLQVITDFENSMDTYFPSINYRNNTAYLEGYIIGAMISAFIDSSGGNLDAKGLLNYMYTVQQVTSAGVSFGKLSVGSSPCSLGLRTNYIYAYNQKSQTFSEFNIRNYDMNGCGLVKYKNSKKRAAPTIDISSLEQPLVFARLIPFSGDESLSSSKLSLLNDVIDADDYSKGLSSYINVYNTKTTNQKIQIRTEYFGFTDSRWSLETKVKNMITRQKVFAFVTGFSSDEDFATIDNIKQILTTYDTPMLTTSNSLELRKPFSKYFINMKSSVLDEVASQISYFKNYGSIAIIYHNIPYWTNQSIPLIAEYLEYNSISISLIQGFSGSSDFSSLGVKLQEGNIQSIVLISGSSMSASFISSLIMYQTTYTPNIGILSEAYNNDFVSKTFTVNNYKSALFAHNFLYLSTITFAPKIYSSDICSLSTSSLHTDKQNSFISLFMSNYNYNSTATHMTLEGYSTGFFIETLLNRIYQEMGITKLSTDDLFSGIYSAQTFDISGLNTFGPFGLECSSQSSQLTTNQTSSSCNQKSTTTCDCNQAPRKVYLSRVNIVPTENYYTFTDIDYAFDFSSSCGVSVVKPVLSTTAIVLISLAGFFVILLVIIAISIAYVCISRSESNTKNAPKTGNICCCFTDIQNSTVLWEKCEKGMREGLKLHNDVLRNQLNLFKGFEVKTQGDCFYVVFKDPLDGIDWAMSCQHELMSIAWPSELLQMYDCRTEFNNETKEIVWNGIRVRMGLHFGYAEKIFDKVVNRPDYFGNTINAAARIEASTQGGQVLISEDMFSELWKIHGTNLFKSITLKEDNQATYLETISPSFKSVNGIGESKKSKDFQAIFSTKGRSIKYSENTESTKSEDRKLKYHANDLGEFKLKGLQGMIRLFEIKSDKILERKYSENLRNTEVTKLDMLKQGSQLKSTRTILPLN

SEQ ID NO: 166 - protein, 1444 aa, Naegleria gruberi
MTGVQAAFKEINENSGGVWGGKKLRLITLDDGYEPARTVNNTIQLINNNTIFGLIGYMGTGTSQAAFPYLTESKLPFIGAFTGGLFLRTPFVSNIVNIRASYQDETVAMVEYLVTVKMVRRIAIFYQNDAFGMSGVDGSSLALTALGMSLVSRGSYERNTIVVAKAVSDIVAGNPQAIICMSTYKPTLEFINTVKNRTDFDPNIVFMTGSFIGSNILPYRDSVVITQVLPPPTNTKYPIVLAYQRAMKASNPNFVPSYVELEGYIAGKMAANILTQRVSGDLTRSNFLQLVYSTSTYIIDNQVIGPYKQCSSSRSLHYFFDDPQNQDAFLYPVLQPRTRLIPRKIESTFVAPCSCNQGLRSIWKTSQNADSSFSEISDPMVWDTTSTTNYTCFYDPTKTLPPIVFGHISSGDKYDEDFLVGVLLAFNEKNNQKGIRGSVLRILTKTPSNSSASALIDTVNLLKNDFNVLGILGGFLPSSSYAQFVDQFKTQLPNTLFLSPSTSYDSPTLRSVFSPNIIHIGLSIREKLATFFDFEMNANGHSRFSVVYGKSTEGAADCKEFKNQLSQFGLTVESEYEHSSSVTDYKLVTQALVSNDGNPQSVVVLLPENISSFSYLSTVIKGIVNIGKRDDLSIFFLYFKYTSWVADVFNLMASLNTKNNVYLIQRYPHVVDTQLPLVAAYNNLFSKYYSSSVSTTGSLEGFLAASFLIEVLENISPSADINGPSTIFTIYQTQQFLKYSIPFGNFISNSCNLGMRTTYLYKLDGSTFTNVKIQSFDKTKCGLSEDIFSSESSIEKQLLFGRLLPVEDASLPYDDFSVGLNALFTSYNTKGTLDTATLHLKTLYYSSREEMTKKAEELILKYKIFGFLGSRLVYDVTELKAIMENYKIPIIGPLSSQLALREPYSRFVVNLRPSIVEESVVLTRYLTSVITSRKPTVLILSGSSYYWQQNSNNVVSFYSKSIEGVSISSTSISSVSSTSGRAVEGSKPDLVLLLASPTEVSQFLTNYPTFSSLIGIPSEISSISSFKTLLNDIPSSVIISPQFLERYDKASSTNFMARDFLIDMAKYSTSSNTSTLMYEAYAVGYMTTTVLKFMSQANMDYSREKFVSTFFERSVFELGNNEFGPYGDECSIQSTFVVKGSCESVSVCNCSQGVRALQINSLTSSSDSILYEMNFKTCGLQAIEPLLSDGAIAGVAVGGTLAFLGTLFVILVLIFCARNRSSVKNAPKSGNITCAFTDVQSSTKLWQNNEKAMRNALEIHDKIMRKNLELFRGYEVKTNGDSFFVAFKDPFDAVLWSLTVQLDLLNANWPSELYHEYDCRQEWDERIKKPYWSGLRVRIGLHYGKGDCKWDKTMKRFDYFGTVVNKSARIEALAHGGQVLISEELLEVTKDLFQDVKKIASCDEFPAYQTTTKEEKKLAVDDKTSTTASLKHQNSLSSVLVDYV

SEQ ID NO: 167 - protein, 2027 aa, Debaryomyces hansenii CBS767
MSFLRRDKSKNNIFNSFAAGQYNMSTNNPNNRETNEMNSNKFQEPPSPMTDNFEGSAMNTTTNQTGANSSAIGSENGANTRPKLDKKSSSNGVYPTSSSSSMSSNDRNEGQIFFNSKFSEHDDRIVSQGHHSQVQGNQAQGSQEQGNQVQQQQKMPVRNSSVGFNNEAMYSPRSSIVSLSTPPTQSNNNSELAVSSEQSHIKDNYKGFHANKRPKGLANIPPLAHPIKPRFRKKGSSLLGKLIYSSRKDSEGSQQSGESAPQHSIEVEPEMPEERDQQRRNSSGNNGGQTQVNKKSVSSAGSNSSKHKFRIPSISLDHHHHHHSHNDEPEETNQQPRAHSTSSAEIRYNNKGGDKKMPTSFDLDMDINEMQGIVKSPNQSSTHENKNPLSDIDAARSFTFNLTDTNSKVPLQQTSDNVNLLMQRSSSSVASSVPSGNVNTRQNVNRSGGGWRAPDSWDVKLNGPLGSAKGDNRSLSDSDNEDKMDDRISSADTSSTLSNSMNQLNDKPTNKLQNAQQVSPRKQNKKSDVRAETPKNSRSNLPVLYGSSNISHVVPTQSDSKSLTKGPNHIVRVFKEDNTFTTILCPLETTTAELLNIVQMKFFLESTTNYQISVYIGNCVKVLEPFERPLKIQMGLLMLSGYSDNDNLRIIGREDLSYICKFVVENIYLRNLTHEEEIMLSKDYVDVNISNSDLKNIPIIFHQHTYEIEKLNVSDNPSIYIPLDFIQSCTNLTSIIFSRNGCSKFPINFLEAKQLTHLNMEKNFLDDLPSKIGHLRNLTHLKLNSNQLSTLPKSFGKLQNLVSLNLSSNYLEAYPEAISELYNLADLDLSYNDLSYLPESIGKLTQLIKLNVSTNKLSKTLPLYITKLISLKRFDLRYNKLTNVDVLGSLPNLEVVYASKNNISTFNDEMESLRLLHFDRNPITDLTFDTLLPNLAVLDLSKAKITAIPPEFMHKISSIEKLVLDKNHLINLPNEIGNLTKLAYLSAYGNNLQVLPPSIDKLVSLQYLDLHSNNLQLLPNGIWDLKSLTYLNVSSNMLSTLPQPPLSVAKRISSTANFRQSPISGLSSESDSRRPSFQSVIESDSTNTPIEPTDAIAEVSSEGGPYEESSTSSVNFNNSSGSLADSLLVLVLADNRLDDDCFDSISFLVELKTLNLSYNDLLEIPEGAARRMTKLVELYLSGNELTSLPTDDLDNIKSLKLLYLNNNKFVSLPAELSKLVNLQHLDVGSNQLKYNISNWPYDWNWHWNKNLKYLNFSGNKRFEIKQSHMKNPDTGEDFDSLLVLKNLKVLGLIDVTLTTTSVPDHTIDMRIRTTASELDNIGYGVSDTMGMRDHVSSRDIFIQKFRGNENEVLICSIDGKSGSPNHTHRISALVKSLFVPNFTNELNKLKNEEGIQDAIRRTFLSLNKEINGILSAKKYNCFNPSSQISPEFADLNLRDDAAAGCAMSIVYIKEKKLYTANIGDVETLLSMSNGDHILLTNKHDPTNRTEFERIRASGGYVSGDGALDGDLAVSRGVGFFNYLPHTHSGPDISEIELTSADDMIIMATKVLWNYITFEIAVDILRQEKNDPMIAAQKLRDYAICYGATDKIAVIVITLGEKKSNKMKFGTKAFYNNLGQENDVFAKKRRDRSQLLVGDSTLRRLEEEIEPPEGILALAFTDIKNSTLLWDSYPVAMRSAIKIHNAIMRRQLRIVGGYEVKTEGDAFMVSFPSPTAALLWCFNVQQQLLKQDWPAEILETDHCCEVTDSKGEVIFRGLSVRMGIHWGSPVCELDYVTRRMDYFGPMVNRASRIMAIADGGQIAVSSDFLAEIRALYKIHEDVTSGATTLYDAYQGNVRGGEIIEREIRSIEEIKWSFFELGEKKLKGLETPELITLVYPKKLEVRFEIFQKRLFHIEDSQSSTRIVGTLPVYSIYGLRTVSLRLENICSCINGGVHVNEGFQMNSSDLISEKINSSFKESDLMGLLNHIVTRIENCAATLHLRQQMSLLGDKGGYIDFTQIQPISNVMDDLKNLIEQFEQYKMLQEGL

SEQ ID NO: 168 - protein, 2099 aa, Paracoccidioides brasiliensis Pb01
MARRQRDKDRNLRRGSEMPSSLLWRSPDALLISHGHGLERETRRPSRAREISDQDDRSCLGTLEAFILLKMWGNAVAQTRLNSTSRHASSSKSNSNAPCRPHSPDVSPTEVPTTSFGNHKKALAILGASDDPSVSQMFLQYSSTNARKRSPSWTPPASLKTTATRGTFFNDGSDAEETSPQFQLEAARTDPSNSPEPVHDEHRRPSVASATTVSSQGSKGSGGRFHKRLRGFFGDEHGSASDSALPERSLSNRIPTSSGSQSKSVFYLLVVVPDHALLYLPGSLYAFPAVSCSQIASFDIPNYGDAPVYPVPGDPDIERFGSMTDGERDSKKDSRLPFHRHRHARSKEEKPSDPGSNSQHICRSSDHDNHKQVYSKVREGTLSPTIPTALGARSISPSPSLQGGSGQESQGTRSPGGSSNKRSFFTKIRRHPKAPIGSSLRGMPSSKSAYDGGGKGSRFLKRDMSPSRCGRNSSFDSVTNTKPWESVESDRKKESAKGVSKFRHPRFPFGHDTGNKDDKNRQDNFEQDRIWKLDTDLTNLSGIVAQPQPLSPTDCGGIYTGTPLPEHKEREFRNPFEPSSTGDWHAPESWAVRKVGDDILSRLPELTDDGGAMVDDEGRPYCVRIFRIDSTFTTLSSNLNTTVTEILEMLGRKSFLQDELNNYDIVVRKNDLSRTLDYGERPILMQKKLLEQAGYQPSDRIADIGREDNSYLCCFTFLPTKLSGYSSLDADLGINENQKFSHVDLHGRSLITLPITLYKRASEIISLNLSRNLALDIPKDFIQSCINLRELKYIGNEAWRLPASLSLATRLTYLDVSNNRLEQLDNAELHNLQGLVSLKMSNNNLSTLPAYFGDFPALRSLNISSNSYRTFPECLYNLKSLVDLDISFNKISELSDIGRLTTLERLWVTNNGLHGPLGETFRDLVNLKEIDARFNSITSIDNITHLPRLERLLIGHNSVSTFSGSFMKLRTLALDHCPVTEFDLTSPLPTLTSLNIASAKLNHFVTLSSYIGTLRKLEHFSISKNPLSTLPPTIGCLTELKCLNLRECNLNKLPSELWYCCKLETLNVSSNVLDSFPKIAGSPPIPPNEYHGNGTPATTPGLVSPSHEELGKLEDFEARRPSHSSSGLLSVGSSSANSSNRKGSIVSMPHNPTVKKSSVASRGATETPSSRKDSTFSQRISFTFAGSLKQLYLADNRLEDDVFQQLAFLVEIRILNLSYNELTEIPQGLLRRWQYLVELHVSGNQLSALPSDDLEESSSLKVLHINGNKFQVLPAELCKVNRLAILDVGSNSLKYNVSNWPYDWNWNWNRNLKYLNFSGNKRFEIKPNTSYTSGIPAGRADVIILSGSLAYGMADSLGRNEHLSIVDMLVTRFRGNQTETVLGLFDGQSSSSSGSRIAKYLQEHFTTSFTEELKKLRPSGETPLDALRRTFLGLNKDIATAAQRSSMDDRELHHFERGTTTSSKLLTKDDYNLGGVATVLYLQNMELFVANVGDAQAVLVHSNGDFKFLTCNHDPAEASERERIRAAGGFVSRNGKLNDKLSVSRAFGYYPMMPAVIAAPSTRKVTLTAQDEMIILASGELWEYVTPDVVVDVARSEHGDLMIASQKLRDLAIAYGATNKIMVMIAGVSDLKRRGERPKLRNHSISMGLSPLTDEHLFTTPSKIKKRGRPGDSRLARLDRVEAPTGELAIIFTDIKKSTSLWETYPVAMRSAIQIHNDLFRRQLAQIGGFEVKTEGDAFMVSFSTATAALLWCFTCQSQLLEAEWPTEIMESPACRPQYDSDDNIIYRGLSVRMGVHWGTPVCEQDPVTGRMDYFGPMVNRASRISAVADGGQIFVSADFVAEIQRNLETFADYDRIGSMDSSEDNYIDDYLNHNIRRELYQLSTQGFEVKDMGERKLKGLENPEFVYLMYPHSLAGRLNAPRAEIEEADTLPIPLGQDKHLSIEADLVWRLWTVALRLEAFCSALENFGEIGLRQPEMGLIDAVKQRPGELSDAVVLSLIEHQVTRVETCANTLTIRHMMRPFKRGNSLKDIAVPMSDILNQLKVQLSEFRALKESISPIIDSRDPPQSLAVLKSPIQSSSALSDIMAVGGSSSSSTA

SEQ ID NO: 169 - protein, 2015 aa, Tuber melanosporum Mel28
MNLGDHRRDLSVLQTPPFVLRQNPPSASNSPANGTASSAVAPSSYLNNNSFDSQDQFGLSPPVRPGTAPSAGTQNSSDAYFPIDDRRPSVASVVTNASSTGSKSSIGKSFYSGYKKFFGDNDNNNAGESPGSSESSLPPNATPRSHYGFPRPTTPTNSRPRTPLPSSDVVPFIYQDPDVSGLGRLVDIRRLGDAPVRDAPIVDRQRYGSEDTSASSSHSHRLHLHRNRNKERDKEKDRAFEKELPPRPSSASKDSMSLSGQDYRRGLRLHLDGTASSHSSQTRLIRPGSPTPSIASSLSNNPPKSPGENTQKKTSLWDKIWKKDKEQSGDSEKEGSIRSKRSKFSEKPTDPLNVSTSGISPVHTTPKRGSGSNEFVNPRAFDYAPVEQMPARKQITGKAPESYGRVKAAKRGVLTYEAPGGKDLGSNRRCRGSKGSEEAGTTFQLDSDFSNIHDIVKLPGPAQASDPGPDNPRLIHEEMAPPARSDITWKPPESWDSGDPENVAPEKTVEDEGGEEDAQYCIRVFRADSTFATLSCRLQTSATEVLHLLGRKSFLQDDLKNYQIVMKKNGVQRILGPNERPLKIQKRLLEQAGYTEDDHLDEIGREDHSYMCRFTFMMSRMGNNYSLDQDPGLGKLQKYSHVDLQGRNLLAIPIALYHHAAEIISLNLSRNLSLNIPTDFIQQCVNLRKIEFQGNEAEKLPQSISAASRLTYLDISNNRLEELDHASLENHGSLVALKMANNRLRTLPDTFSQFKCLRSLSLSSNYLNVFPPFICELFTLVDLDISFNLIKTFPFEIGQLGNLDRLVATNNRLTGSLPQTFSLLNGLKELDLRYNNLINVDVAADLPKLELLLTGHNSISGFQHSFPKLRALHLNSCPVTRFSFPSAMPTLKFLNLQNAKIAALAETLFERLPNLERLVLDKNHIVSFPPQICKLKKLAHMSCFNNELASLPKEIGQLTDLRVLDLHENNLKTLPGEIWQMTNLVTLNVSSNLLREFPKPIPNPAAQSPSAETASILSLGKDDEIVKPDTSRRPSQGSGGLLSVGNSPGGGGRKGSLVSIYGPGGRKASVISKSGSEHGSHLSTRKDSAASSRISNTFAFSLRYLHIADNKLSDEVFEQLSLLSELRILNLSYNEIYDIPSRALSRLSLLNELYLSGNELTSLPAEDLEYVASLKVLHINSNKFQTLPAELGKVRKLLVLDVGSNALKYNISNWPYDWNWNWNLDLKYLNLSGNKRLEIKPDRSGSGSGRGRSITDFSQLSKLRVLGLMDVTLTIPNVPDQTEDRRVRLSTSMVRTMAYGMADSLGRSEHLSMIDMVIPMFRGNRNECVIGLFDGQALSTGGSKVSKYLHEQLDTFLKDELEKLQPDEEPGRALHRAFLNMNKEMATVAMQTIDEKNLTGVGSHRGSTVTGAFLGPDDLVSGGSATVVYMKGNNLYVANVGDATAMLVQSSGEHDILTKKHMPGDPQELERIRDAGGYVSKSGKLNDVLDVSRAFGYYHLMPCVNAAPHIHETEITDQQELLIIASKELWEYISPQAVVDLARQERDDLMRAAHKLRDIAIAYGATNKIMVMILNVGDLKKSKSRMRTQSISVGPRQTYPDEEALFPSVKAQKRRGKNEIPDDFALARLDAEVKAPEGDLAMVFTDIKNSTLLWETYPTAMRSGIKLHNSIMRRQLRIVGGYEIKTEGDAFMVCFPTATSALLWCFSVQAILLDAPWPSEIVESIHGSPVQDANGHLIYRGLSVRMGIHWGAPVCEPDPITRRMDYFGPMVNRASRITGEADGGQITVSSDFVAEIKRCVKAYQDSELVGGLSPEDPFGDESLAQTIGRELRTLSSQGFEVKELGERKLKGLENPEFIHLMYPQSLVGRVANLGPPRGEVSKTTVDPADIWALWEISLRLEGLCSSLNTDGVPFLKPRGLEMTARLKLAGENATDQVLMPFFEHIVTRIENSMTTLFLRRVLAPPGCGAEEMASPLMELLSALEARAGVNISGRAIASAAYGGVGSSASSSYSAS

SEQ ID NO: 170 - protein, 2109 aa, Arthroderma otae CBS 113480
MSMPQDPTRYPDARNGSETSSTGSRRSEDTVKQDDSNSRARPSNRYREEGSDSSEVGAGATIASAFPTNSPNISPRERRTSYGFGNPKKVFNMISHREELVHPGKSTIPKLALVSHGPSATSSPKLPSDASQQRTFYHDSPELESSPSFEPFTSQAPSNSLRPDEDEDDGDNLRRPSVASATTVGSQGSRSSGGRFHKRLQGIFGDDFDQQDVSFPSTLRSSSRLSSSRPRTGSAGRVRKGSTNSLIDRTASPDPARPRTPIPSSEVTPWEYQDFKDIPNLGEAPVRQAPTDVSEPQPAIAPKVRPTHRLHLTGHRYTQSKEDPPSSANISSPIPSRPASGRDEIPPLMRSSREHSLQAPTPMSSSTTLGARSASPTPSTRSINVRDIRDQSSPYSSAPKRSFLDRIRWNKAPTNPLKNLPSSSKSVQDTGKVPSYFGAEPSSIIRGRKGSSDSNSRQWENNDPDRKKEGSTSKALSAIGPSRLRHGRRGKSGRERRDKNDVNNVFLDTNLGDMSGIVTHPDAISPTDTSVGIFGGSKPFLANGEALAPLDLIGTDDWHPPDSWQVKRPTEDGGTRLSSVADAGPEMDVDEDGHPFCIRVFRIDSTFATLSAGLNTTVTQLLEMLGRKSFLQEDLNNYEIVMRKNDLSRTLEPSERPILMQKRLLQQVGYHMSDRITEIGREDNSYICRFTFLPTKLGVYSNLDPELGFTDNQKYSHVDLEGRSVATIPLKLYKKASEIISLNLSKNLALDVPKDFIQSCINLREIRFTSNEAWHLPPSLSLASRLTYLDISNNRLEKLEHANLHKLKGLVSLKMANNKLSSLPANFWDFPSLRSLNLSSNNFRALPDFLGNLTSLVDLDISFNQIEDLPTIGQFTSLERLWVTNNSLSGPLVETFKGLTKLKEVDARFNNITSIDNMSSLPRLETLLVGHNAVSAFSGSFPRLRTLVLDHCPVTEFDITSPLPTLHSLNIASAKLVEFRDSLFANVPNLTKLILNTNHFVTLSPNIGSLKKLEHLNLAKNPLSILPASIGCLTELKSLNLRECNLNRLPAEIWYCLKLESLNVSSNVLEMFPKPAPSPPLPPSESSNSLTPMGTPLLRADSYDDVSGRSEDYDFRRPSHASTSRLQVGTPPDSTRKGSIPSMSSPGGRKSSNASRATAESRKDSTFSQRIASTFASSLRQLYLADNRLEDDIFHQIALLTELRVLNLSYNGLTDLPPGFIRRLQYLAELYLSGNELSSLPSDDLEESSNLKVLHLNGNKFQVLPAELCKINKLAVLDVGSNSLKYNISNWPYDWNWNWNHNLRYLNFSGNKRFGINPSSAYTPSLDGTPSTDLTDFSSLTYIRVLGLMDVTITIPTIPEETEDRRVRTSASLSGYIAYGLADSLGRNEHLSMMDMVVPRFRGSDMETIIGLFDGQPSMSGGSKIAKFLHENFTSTFMEELGKLRKQNGETPEDALRRTFLALNKDMATAAYKPVDDKESRHWDRNPTAAKLLNREDAFSGGVATVLYLQNMELFVANVGDAQALLVQGNGQFKHLTKNHDPAEASERERIRRAGGYVSRNGKLNDQLSVSRAFGHFHLVPSVIAAPSTVKITLTAQDEMIILASGQLWDYVTPNVVVDVARSERGDLMIASQKIRDLAISYGATNKLMVMIAGVHDLKRRERSKFRSTSLSRPSPLNDEHMFPLTKRAKRARDIPSDSTLARLGHVEAPTGELAIVFTDIKQSTSLWETYPLAMRSAIQIHNELFRRQLRLIGGFEVKTEGDAFMVSFSTATAALLWCFTCQMQLLEAPWPTEVLQTPSCRETYDDDGNLIYRGLSVRMGRMDYFGPMVNRASRISAVADGGQIFVSADFVTEMERTLEAFADYERTNSESSEDTFGDEALGQATRRELYQLSTQGFEVKDLGERKLKGLENPESVYLLYPHALSGRLSVQPDMVASGEASSPGTLGKNSTLNIDADMFWQLLKIALRLEAFCSALENPSGTILLEPDLQVINAIKARGDEIDDAAVMSLLEHQVARIETCTNTLTIRTMMQPFKPNDTLLDHAVPMADILQQLQSQLAEFKALKAQINLNEAPTTPPPSGYSLEMPESTISSAKSSALNLAAPSAPK

SEQ ID NO: 171 - protein, 1852 aa, Coprinopsis cinerea okayama7#130
MTEVSLRLSEDAVDHNGVARMTHIAPGPANDDSTIAPWLDIPPTPPPKSPLRSFNFPKVSVSSIATTRNGSYSNGSRYPRHSESQSTLSIPPDNRRSVEGDGDSSRHNFYSGSSSHSNEIRKSKSSIGLNVLSKLRGRPSKANLALSDSKSTDASQHPSLQPPEPPLPSSSFMNLASANSSFLSLGKSAKGKEKRKQSRHPPTPPEKDELEHQHLMDLDIRDMSGIIDPRAHSAQRHEPSSPSLSSGRSDYGVFLRHQPAGSDYRQLQPSDFSNPFVKSSSHSGRRANDRRISPTTVISPNGTLYRHHATNSIISTGAEGSPTWVPPESWAVENYDEDAMEAAAYSSSDESVHGSHSVDRPTPLTERPTLPPPVADPSTPKAMRRKRPRSSHSDKLIYRMKIFHSNGSWRHVAISLDCTVAQLNKELFAKAKWDSDRKDRLYLSEGGRERLLGPTERPAKIVKRRLTLAGYLPIDGLDTLGLEDLPFLFRFSYKSQLLGPPEEDLNFESFDFIDLTGRSLRTIPVLLHQNADSIVSLKLSRNPMLEIPLDFIQSCSLLRDLRLSNMAMKKVPQSVQYSSTLHRLDLSSNRIADLTDAYLDHIPNLLELNVMNNKLEKLPWHFGRLRCLVTLNISNNRFTEFPKEVFQMKNLRTLDVSFNTIKVIPEELGQLAELEHFLLVGNQISKFPDQARELHNLSMLDCRRNSVSDLTIVLMLPKIQQVYADHNAISSLDLSIGPNMKGLDVSHNDITQLSLIPGPVGRSPYSLTSLDLSYTKLSSLDDLALGTLTSLKTLKLDHNTIRSIPDTLGELSWLETLTVSDNRLDSLPDSIGRLQKLETLDAHNNSLSELPQSLWNCASLTRINVTSNFLGSWHDPPVSSDVGIDDASSLYLARKGSTASTTSTSGLPPLVHSLERLYLGENRLTEESIHPLMIFKELRVLNLSFNELQELPPIFFRNMTQLEELYLSGNKLTSIPTEDLHRMTRLSTLFLNGNRLQTLPQELGKLKDLSILDVGSNMLKYNINNWEFDWNWNFNKKLKYLNLSGNNRLQIKSESSRNSASHNRTSRLDFASLGRQTLAGFKELASLRVLGLMDVTIATTGTDASVDIPDETDIRRVRTSPSTVNGMAYGIADSLGRNDVLNMLDLVREFPASPGEPKPNKAIFAMFGRCQPPKGLLPGTSPNKLSKFLHDHFTEVFIRQMNELPEKKGGVSDALRRTFLELNQKLWEHIHQLKRKNSQATPMPAPNGTLVNSGFDPGLLNIGATSVVLYVVDKRIYVANVGDAVAVLSRAGVAHRLSHRHHPYDREETAHIRSAEGWVSPNGLINDQVEVSRSFGHFNLVPVVRAAPDIFSQPLGDRDEFIIIANRGLWEFVPHQTAVDIARTVAHIDPMIAAQKLRDFAISYGADGSTMIMVIMVSDLFKDPRSRQPTLDNIVLPAKVPKRKKEERIPGNRHLPPEVDAPTGHIAIAFTDIRNSTHLWEVNPGMPTAMHLHNHLLRYHLRRCGGYEVKTEGDSFMVSFPTALAAVWWCVTVQKELLNVSWPLEILECEDGKEIRDEAGNIIARGLSVRMGIHCGVPVCETDWITNRMDYFGSMVNRSARVNSHAQGGQIMVSADVLREINARIYDKVEEQTEYSRNQPQDAIDGIREIGISLIPVGEVKLKGFEFTEMLTAVYPKGLEHRHGMKDANVSGAASRIQFSVPQTKELGILCLRLEALSGGYLFKTPPPARKGSIASQTASLLPGAGPHPGSSSNTTEEATSNEAEAEPQGPPVIVADPETLLPPINDQISDADLMRIIDWFAMRIENAVNMLAHRYCPPNMDRVNFINALIEGEQLDARTLEYISGILKRIS

SEQ ID NO: 172 - protein, 1408 aa, Schizophyllum commune H4-8
MAQNKLYLKERGRERVLAPSERPADILKRRLEMAGYEPTDGINTIGEEDLSFLLKFGWKTQVLGPAVRLISADHDALLTFSKEEDLVFDNFEYVDLTARSLRTIPVVLHKNADSIHSLKLSRNPMLEIPLDFIQSCTTLRELRLSNMAIKKVPHSVRHSKTLQRLDLSSNRIADLDDAYLSEIPDLMALFVQNNRMERLPWHFPRLRNLVTLNISNNKFNEFPTAVTQLVQLQDLDISFNMISELPEELGKLTMLGRLIIVGNQVSRLPDGCARLRSLRVLDCRRNQISDFTVVCNLPRLETLSADHNAVHALDLSLGPCVANLDASHNEITQLSLLPGPIGRSPVALTSLDLSHAKLALLDEHILAELTSLRVLRLDHNSIRMIPEALGELEHLEVLSCSDSYIVSLPSSIGRLQNLVSLDVHNNSLKELPVELWHCGSLARVNVTSNLIKAWPEPPVFSTTPVLALPSNADARSDRKASVASLGAGRCMPPLAQSLQKLYAGENQLTYDALPSIACLRELQVLNLSFNDIQDMPSSFFRTLTKLEELYLSGNMLTSIPTEDLPKLTRLKTLFLNGNRLQTLPQELAKVKSLMALDVGSNLLKYNINNWEFDWNWNFNKNLKYLNLSGNKKLQIKSDTRAVRQHNVPTSSLTRQSLAGFTDLHQLRFLGLMDVTITPGGMHGGADIPDEKDDRRVRTSVSTVSGMAYGIADTLGSNEQLNMIDLVHDFRRGHGEAVFAMFGRAQPPKTIRVGTSSNRLAKFLQDNFIRVFRDKLDDLARSPGDDITDALRRTFLRLNQELHDSLVNSHRKMSTHSGSGANNTVIDPDIARTGASGLVLYFKDRTLYVANCGNALAVISKQGIAQPVSRKHDPYDRAETARIRAAEGWISPPGLVNDEIDISRSFGFFHLLPVVNARPDVHTYHLDESDEFVIVANRGLWDYVSYQTAVDIARSEWMDTRDPMIVAMKLRDFAISYGAEGSTMIMVIGVTDLLSHETRQRQATMDSIPEMSGLVGKRTRRKDDVGDRDLARLDGEVEPPTGNVTLVFTDIRNSTHLWEANPGMRSAMIKHNALLRRHLRLCGGYEVKTEGDAFMCAFTNPMSALWWCLVVQRDLLREDWPLEILECEDGKLIYDVDGKLVARGLSVRMGLHCGHPLCERDPITNRMDYFGSIVNRASRISGSAAGGQIMCSADVIRELNASVHRSEPPTEYTDLQPAQAVNAIRQMEVAIVPVGERKLKGLEVPEMLSIVYPKELQARQFIEEMPEDPGTSGSRIQFSIDQMRELGMLCLRLETIASERVFRALPERKGSFQPGMEGGEAEELNEPSSSVYYYGDPSVLLPQMSDKLSDRELMSLLDFFSVRIENALSTIQQRHGARTKEQRLTSALAGRLDLDERTLQEVLALLQSV

SEQ ID NO: 173 - protein, 1679 aa, Nectria haematococca mpVI 77-13-4
MTWGSKSSQLDGQTSPGHHGKRGLLGRFRRHHKDKEDTARLRDLPQSTKSLQPKSSKPDLYRPELSPSVLPLSGTFGPGDQSDVPDSRPGTRGAATFNNKFPFSKKGRSHRPHDYVDESIGPTDRNDPEKIYHLDTNLNDMEGILTKPPPLTPMDISFVNNVEADRTDSVVSIAPKGRWDAPDSWAVRRNTEDNSYHGPDLDEIGSPPRPEEKTAPYCIRIFRSDGTFSTHSMSLDSSVTDVISQVIKKTYVVDGLENYHIILKKHDLIRVLTPPERPLLMQKRLLQQVGYEDKDRIEDLGREDNSYLCRFMFLSARESDFHAKTTDMGLARAQKLNYVDLSGRNLITIPISLYSKAGEIISLNLSRNLSLDVPRDFIQSCKHLRDIKFNNNEARKLPPSLSRANKLTFLDVANNRLEQLEHAELHILTGILKMNLANNRLKHIPSYFGAYMSLRSLNISSNFLDKFPLFLCQLPSLVDLDLSFNGIATIPPEISGLKNLEKLLITNNRLTHAVPVSFRNLSSLRELDIKYNGITSIDTISELPKLEILSADHNCVSSFVGQFESIRQLKLNSNPLNKFEITAPVPTLKILNLSNAQLASIDSSFANMINLEHLILDKNYFVSLPQEIGTLSRLEHFSIANNSVGELPAQIGCLNELKVLNVRGNNISKLPMELWWANRLETFNASSNVLEHFPAPASRAPRMPGEETQPEKPPVNGRAAPLGTLSATPSSEELSDERRPSQNSSTLLSVGPSPLAGDRKSSVVSVYGKGGRKTSVVSRATAPSVAMSTANPRKDSSSRFTNTFAGSLRNLYLADNRLDDDVFEQISLLPELKVLNLSYNDEISDMPQRSMKRWPQLIELYLSGNGLTTLPADDLEESSLLQALYINGNKFTNLPADISRAKNLAVLDCGNNFLKYNISNVPYDWNWNLNPNLRYLNLSGNKRLEIKQSTYGPSGPGVVDREEYTDFSRLLNLRILGLMDVTLTQPSIPDQSEDRRVRTSGSLAGHLPYGMADTLGKHEHLSTVDLVVPRFNASETEMLLGLFDGQALSSGGSKIAKYLHENFGHIFALELKSLKSQTKETPIDALRRAFLALNKDLVTIAIQHSEERPLKVHRGSGQPVILTKEDLNSGGVATVIYLQSTELYVANVGDAQAMVIQTDGTHKMLTRKHDPAEPSERSRIREAGGWVSRNGRLNDLLQVSRAFGYVDLMPAVQAAPYVSNMTLKETDDIILIATRELWEYLSPGLVTDIARAERGDLMRAAQKLRDLAIAYGASGKIMVMMISVADLKRRMERSRNHRGTTSMSLYPSGIPDGAQVLSTRRGRRGKGDVLDSQLNRLEAEIPAPTGNVSIVFTDIKNSTTLWEMYPSAMRSAIKLHNEFMRRQLRKIGGYEVKTEGDAFMVSFPTATSALLWTFSVQTGLLDVPWPSEVLNSVSCQPAYDKDNSLIFKGLSVRMGIHFGDCVSETDPVTRRMDYFGPMVNKASRISAVADGGQITVSTDFISEIQRCLENFQDTDRSNALEAEDSFEDETYASAIRRDLKHLTSQGFEVKELGEKKLKGLENPEVVYSLYPHALAGRIEFHQQHERREGGGGGDKPAILAPGAELTFDPDMIWTLWRVSLRLEMLCSSLELPRDEAPGGLQSPETELLERIKQRGGEVTDRFLINFMEHQVSRIEVSRN

SEQ ID NO: 174 - protein, 2120 aa, Glomerella graminicola M1.001
DLSPVEPPSSIFASAPRGALSPVAPKPNSNVSPLRDHRLSDFANYRRDLAVLETSAGRLPSIQHNPPTATLSSTSQVAPWMSPSNGGATASTPHQTTFYNDSSDNLSVASQLSPGFRPPTHRIAPQSSGSQDSPDVAYFADERRPSLASITTLSSQGSKTSIRRGGLQKLQGFFGEEFPGRDGSESSLHSSSGRDRSRSYSHSRPTRDRNYSNATDHARDREGSPSSSRPRTPVPAPEVVPFLYQEADDIARFGEAPVRDILSGPDRERYMNNENPNNSQNPPKTSSSNRSGHSIVHLPGHHHRHNRSIDDGKALRPTVSREDSQASLQVQNSRERGASAATVMYGSNRSRAESPTPSGGYFSSRHGTIDGSISPGSQHQQPQPQQQQQHHHSKRNLLHRLRRNKDKDDGSSRLRELPGSTRSLATKPSRPEFARPEMSPSTFPLTLSGTEPGPDQDPRLAAYNQRNQPQVQTFNNRFPFSKSKGRQHRPTEAQDEQIGPTDRQPGGFGTVFHLDTNLSDMEGILTKPPPLTPMDHAFIASIVDPEKVEPPPVPAKPDAIPGPNGSWNAPDSWAVRRNTEDTTYQAPDIDDVGSPPRPEEKMTPYCIRIFRSDGTFATLSMALDASVTDVISQLIKKTYATDGLENYHIILKKHDLVRVLSVAERPLLMQKRLLQQIGYEERDRIEDVGREDNSYLCRFMFLSSRESDFHSVTNDLGLGRIQKFNHVDLSGRNLITIPISLYSRASEIISLNLSRNLSLDLPRDFIQSCQNLRDIKFNNNEARRLPPSLGKAAKLTYLDVSNNRVDQLDHAELHGLHGILKLNIANNRLKALPQYFGAYKALRNLNISSNFLDKFPLFLCDVESLVELDLSFNSISSLPDQIGRLRNLEKFVITNNRLSNSLPDSFAELSGLRELDIKYNAITSINIISLLPKLEILSADHNSISQFIGSFERIRSLKLNSNPITKFEIIEPVLTLKMLNLSHCQLASIDETFNMMLNLERLVLDKNYFVSLPQQIGNLSKLEHFSIANNNVAELPTSIGCLTELRVLDVRRNNIRKLPMELWWANKLETLNASSNILENFPKPASRQPRPAGEEAQTPAPVNKPNPMERIVQSPLEESQDVSRRPSQNSSSTLLSVGPSPVPGSADRKSSVVSVYGKGGRKTSVVSRSASQGAVPPLPPSATARKDSSLSSRLYTTFAGSLRHLYLAENKLDDEVFDQITMLTELRVLNLSWNYINDMPQRSIKSWPQMVELYLSGNELTTLPADDLEDASLLQVLHINGNKFTNLPADISRAKKLAVLDCGSNYLKYNICNVPYDWNWNLNPNLRYLNLSGNKRLEIKQTVTGPTIPNRESLADFNRLLNLRVLGLMDVTLTQPTIPDQSEDRRVRTSGSLAGHLPYGMADTLGKNEHLSTIDLVVPRYNSSETETLLGLFDGQALSSGGSKIAKYLHENFGHIFTMELKALKTRLNETPVDALRRAFLSLNKDLVTIAIQHTEERSQKTHRGSATPVVLSKEDLNSGGVATVVYLQNQELYVANVGDAQAMLIQTDGSHKILTRKHDPAEPSERQRIREAGGWVSRNGRLNDLLEVSRAFGYVDLMPAVQASPYVSNFTIREQDDIILIATREFWEYLDPALVVDFARQERGDLMRASQKLRDLAIAYGATNKIMVMMISVADLKRRSERSRLHRGQSMSLYPSGVPDDLQQPLRRGKRNKGDVLDSTLQRLEAEIPAPTGNVSIAFTDIKNSTTLWEMYPAAMRSAIKLHNEVMRRQLRRIGGYEVKTEGDAFMVSFPTATSALLWCFAVQMSLLDVNWPSEVLNSVSCQPLYDKDNALIFKGLSVRMGIHYGEAVSEMDPVTRRMDYFGPMVNKASRISSVADGGQITVSSDFISEIQRCLENYQDTDRNGSTGSEDTFDDDQGFASSIRKDLRSLSSQGFEVKEMGEKKLKGLENPKVVYSLYPHALAGRIEHHQQHEQRTEVDKPAILQAGSELAFDTESIWALWRVSLRLEMLCSSLENVSGQGLQPPETELLERMKHRGGEVTERFLLNFMEHQVSRIETCVTTLSLRHIAIGNAPLEQLQDMRGSMSDILDQVAKQMSELARYKALYGELDESEDGSETE

SEQ ID NO: 175 - protein, 2445 aa, Leptosphaeria maculans JN3
MISYHRAQACTLQGLLRTMLELAVGVGVGVSMAVHGAKHYSALSSPLFGRLRGPVAVGARWPTPVQVAQAGSGGERASAAPSLSKWSPQLQCVVVVPKQQRPLEAACLSLLLLFLPHTPPSLARRTALHTRLTLRQNSRPQQRWPSTVSTYRPASSVYRPQSPCLPAPVARRARLCPSLDPHHDVAAHQPAAAHGRITSSAAPPAAPMTRNDAAVDRHGSAESSWSSRSADTVRPYARGVHRGTPVTVKTTKDPNQPRAFVSSGLLCDKADDRWAACAHCASSMARPVVCPSLVRSQSLDNAPHASVAAAGSAAKSWLLYLSLVCRFELLLEHTPSRPTANVLAQPFIEKESEISPGTLPPAPPPKDTSHRLRKPPHWDPPPPTHTLGDHRKQLAVLEPSGIRLPSISRNPPTASSIPQQTAPWAATPNGPNMSNNSVWSSFFNDSNEDVAQLSPGFQRPGTDGREDSMGFPLKDDRRPSVASATTISSTGSKSSISRSFHKRLKNVFGEDFPADGRQSSETSLPYTGDTQSLRGQRNRGNSLNNTIGSGHHSRPASPTNSRPRTPQPSSEVTPWDFQESKDVPTPGENGGRRSSDVQIGKASNRAHKLHVRLPGHNHRSKGSKEENKVSEAQALPQPQPQAQGQAQARTDISQPYPLGRPATSREESAYSIRQNQNQQYPSALSSAFASKISLPGRPSSPTPSSLSDITRDNPSAQRSPSVAKSSHGLFARLRGKDKTKDKTDLVATPEYLKTLVNSSTASAVSLPPSISSTRVPRPEPPPMSKRQPTNFAMEDKVSANNTRRAPHHRLPTFRKTPRMPTGEGPTGKDPNEAVMSTAGNDAVFWLDQNLNDMEGIVNPQQPPMTPPVGELQKQPTLPGDDIPPPGADDDGTAAWDAPDSWAVKRMKDEMDRLGELDESGERLKEDSDTKTYCLRIFRVDSTFATLSATLATTVQEIIQILGKKTVLQDELDNYHIVLRKHDTSRQLESNERPLLIQKRLLEQAGYTDNDRLEDVGREDNSYLCRFTFLPAKMSGYSSLERDPGFSKMQKFSHIDLQGRNLITIPITLYQKATEIISLNLSRNLSLDVPKDFIQACTNLREIKYTSNDARRLPPSLSLASRLTMLDISNNRLQSLDSAELHKLQSLQGLRLSNNGLTRLPPYFGQYRALRSLNLSSNSLNEFPDFLCEVRTLVDLDISFNSISSLPKIGQLTCLERLWATNNKLTSSFPSTLSNLVNLREIDVRFNALDSMDVMSQLPRLEYLMIGHNSISAFEGYFPKIRVLHMNHNPVTRFSLTQPVPSLSVLNLASAKLAQLPEDLFSKLTGLTKLILDKNHFSSLSNNIGMLFRLEHLSVARNSLDVLPAEIGKLVELKYLDVRENNLSVLPSELWYARRLETLNVSSNILNAFPKPGTSPPQVPNGEVSNLDGATPASTPGLGPSPSFEELGKLEDFQNRRPSQASGGQLGTSPASSQRKASLASYNSASTVRKPSLNSRGTTEGVLTPGTITPMSRKDSTLSNKLVTTFAGSLRHVFLADNRLTDDVFDELCLLPELRIVNLAYNLIYDVPPRTIRRWQHLAELYLSGNDLTSLPSEDLEEVGSLKVLHINNNKFQVLPAELGKVAQLAVLDVASNSLKYNVSNWPYDWNWNWNHKLRYLNLSGNKRLEIKPSGSYNGSGMNMREGRDLTDFSSLTNLRVLGLMDVTMMAPSVPEQSEDRRIRTAGSAVGTMAYGMADSLGRNEHISTMDMVVPRFRSHDDEQLLGLFDAQPLAGGGSKIAKYLYDHFKNRFADELERLRPQESPSDALRRAFLGLNKELATAASQSLDKNVYNAPAQPRTALPELGDDDLTSGSVATVLFVKEMELYIANVGDAQALLIRSEGGHKILTKKHDPAEPSERARIRDAGGFVSRQGKLNDVLEVSRAFGYVQMSPSVIASPHVLNLTLGDTDEMVLVASRELWEYLTPDFAVDVARSERNDLMRAAQKLRDLAIAFGATNKIMVMLLGVSDLKSKQRARYRTQSMSLVPAPGGEIDWGAQRRPGKKRNLVGDSKLARLDNEVDAPTGEVSLVFTDIKNSTLLWETYPIAMRSAIKMHNELMRRQLRIIGGYEVKTEGDAFMVAFRTVTSALLWCFTIQSQLLEVQWPQEILNSVNGQEVVDPDGNVIFRGLSVRMGIHWGTPVCEVDPVTKRMDYFGPMVNRASRISSVADGGQITVSSDFIAEIQRLLETHIEGDRSNSTGSEEAYGDDIMSLLIRQELRSLSSQGFEVKDLGERRLKGLENPEYIYLMYPHSLASRLAVQRQTEQQKPPAPAVEGTAAQKMAGSQLTIDTEDVWDLWNISLRLEMLCSSLESPGSTELKPPETALLERMKSRGGEITDRFLVNFVEHQISRIETCATTLALRHRVRPFGSAPLLEQACAMGDIFAELEAKLKRLEQYEAEAMSDMAPS

SEQ ID NO: 176 - protein, 2030 aa, Arthroderma gypseum CBS 118893
MALGRIGHDGPSATSSPMLPSDGNQQQQQQQRQQKRTFYHDSPELQPSSSFDPFFSQVRLNSLRPDEDEDDGDSLRRPSVASATTVGSQGSRSRGGRFHKRLQGIFGDEFEQQDLSFPTTLRSSSRLSSSRPRTGSAGRARKGSTHSLSLDRTASPDPARPRTPIPSSEVTPWEYQNFRDIPNLGEAPVRQAPTTDPSEYQPPTPAPKVRPTHRLHLTGHRYTQSKEDPPNTANISSPLPPRPASGRDEIPPLMRQSREHGLQAPTPMSSSTTLGGRSASPTPSTRSVNPRDARDQSSNPSAPKRSLFDRIRRPKGGSNSLKNLPPSSKSVQDMSKAASYFTSEPGSVLRGRKGSSESTSREHNESDRKKEGTTSKALSAIGPSRLRHGRRFLDGKNVKDRRNNVDNNQVFLDTNLGDMSGIVTQPDAISPTDTSLIFGGTKPFTGNGEVLTPLDLIGTDDWHPPDSWQVKRPTEDTGTRMSSVADPGPEKDVDEDGHPFCIRVFRIDSTFATLSAGLNTTVTQLLEMLGRKSFLQEDLNNYEIVMRKNDLSRTLEPNERPILMQKRLLRQVGYHMSDRITEIGREDNSYICRFTFLPTKLGVYSNLDPELGFTDNQKYSHVDLEGRSVATIPLKLYKKASEIISLNLSKNLALDVPKDFIQSCINLREIRFTSNEAWQLPPSLSLASRLTYLDISNNRLEKLEHANLHKLKGLVSLKMANNKLSSLPANFWDFPSLRSLNLSSNNFRALPEFLGNLNSLVDLDISFNQIEDLPTIGQFTSLERLWVTNNSLSGPLVETFKGLTKLKEVDARFNNITSIDNMASLPRLETLLVGHNAVSAFSGSFPRLRTLVLDHCPVTEFDITSPLPTLHSLNIASAKLVEFRDSLFANVPNLTKLILNTNHFVTLSPNIGSLKKLEHLNLAKNPLSILPASIGCLTELKSLNLRECNLNRLPAEIWYCLKLESLNVSSNVLEIFPKPASSPPLPPSEATNNLTPMGTPLLRADSYDGVGGRGEEYDFRRPSHASTSRLQVGTPPDSTRKGSIPSMSSPSGRKSSNASRVTAESRKDSTFSQRINTTFVSSLRQLYLADNRLEDDIFHQIALLTELRVLNLSYNSLTDLPPGFIRRLQYLSELYLSGNELSSLPSDDLEESSHLKVLHLNGNKFQVLPAELCKINKLAVLDVGSNSLKYNISNWPYDWNWNWNHNLRYLNFSGNKRFGINPSSAYTPSTDGTPSTDLTDFSSLSYIRVLGLMDVTITIPTIPEETEDRRVRTSSSLSGCIAYGLADSLGKNEHLSMIDMVVPRFRGSDMETIIGLFDGQPSMGGGSKIAKFLHENFTATFMEELGKLRKQNGETPEDALRRTFLALNKDMATAAYKPVDDKESRHWDRNPTAAKLLNREDAFSGGTATVLYLQNMELFVANVGDAQALLVQGNGQFKYLTKNHDPAEASERERIREAGGYVSRNGKLNDQLSVSRAFGHFHLIPAVIAAPSTVKVTLTSQDEMIILASGQLWDYVTPNVVVDLARYERADLMIASQKIRDLAISYGATSKLMVMIAGVNDLKRRERSKFRSPSLSRPSPLNDEHMFPLGRRKRKARDIPSDSTLARLGHVEAPTGELAIVFTDIKQSTSLWETYPLAMRSAIQIHNELFRRQLRLIGGFEVKTEGDAFMVSFSTATAALLWCFTCQMQLLEAPWPTEVLQTPSCRETYDDDGNLIYRGLSVRMGMHWGRPLCEKDPVTGRMDYFGPMVNRASRISAVADGGQIFVSADFVTEMERTLEAFADYERTNSDSSEDTFGDEALGQATRRELYQLSTQGFEVKDLGERKLKGLENPESVYLLYPHALSGRLSVQPDMVASGEASSPGTLGKNSILNIDADMFWQLLKIALRLEAFCSTLENPGGSMLLEPDLQFINAIKSRGDEIDDAAVMKLLEHQVARIETCTNTLTIRTMMQPFKPNDTLLDHAVPMSDILQQLQSQLAEFKALKTQMNLSGAPTTPPPSGYSQELPESTMSSAQSSAINLAAPPRPGRR

SEQ ID NO: 177 - protein, 2152 aa, Aspergillus niger CBS 513.88
MSHRNSDQSGGRRSSESSGAHSWLSQETVREGRSHQPQHNHEPSNARSVSPLSGFRDTDRPDPQTCASPTIKDPNDLYSSIFSWGSDFAPKDQRKPPQFGSHRKAMNLLGTEDPGTSPTANLNNRPPQLNLNPPDNSHQDAEPSLASSPTMAPNDGPSTFFNDYSEQEASPASNLFRPGTAQTYASEPLELDYNGDHRRPSVASAMTVSSQGSKSSAGALFKKKLQGFFGDEYVGNGEPRHDSDNFTQNSATKPSSLDQFRARERANSDGSRNPGASPAPNQARPHTPLPSSEITPWLYQSFNDIPQYGEAPVREAPTMTADGQRGSVSQRDQSRRHFSGHRHSRSKEEKPTVAGDLAGYSNRPATGRDDLSLGLRPSREGSLNYPTPMTSTTTLVGRSTSPTPSVQSAYSREQGQNSPGAQTSKRSFLDKIRRPKHGHLKNITGSKAVQETTKAAASKLSRREASPARRGRQGSIESGTSSRLADSGDNERKRDGKGLAIGSAKLRGRRGHGNEVPPGKDTRQPDRSNVWELDTDLSHMEGIVNPPSPSAKSKMFDGASIRSEETRRRDAVPAGNWDAPESWHVKKQNEPSTLLPQDTSEPGPTITEPDGPNWYIRIFRPDATFATLSGGLYATVADLVHGLSRKSFLTEHISNYELVMQKNDLSRQLDQTEMPILMQKRMLEQVGYTEKDRIEEVGREDHSYILRFTFLPARITGYIIDGNDPLGKAQQKFSHVDLSNRCLVTIPIGLYKKAPEIISLNLSKNLALDVPKDFIQGCINLREIKFIGNEALRLPASFGLASRLTYLDVSNNFLEDLTLANLDRLHGLVSIKMANNRLTKLPSYFGNFQYLRSLNISSNNFKVFPDLLCGLKSLVDLDISFNNISELPQIGKLATLERIWMTNNIVRGALDDTFRDLVNLKEIDARFNEITNIDTLCVLPRLEQVAIGHNAISKFKGSFPKLRTLALDHCPMTQFEIDAPMPTLTSLNIASAKLVQLRDTFFENLPNLTKVILDKNHFVSMSPHIGKLRKLEHFSMIKNPLAALPATIGCLTELKYLNLRECNLRRLPPEIWHCLRLETLNVSSNVLEGFPKHGSPQPQVPSEPIGTPAATPGVSTTPSYEELGALEEQEARRPSQTSGGVLSTGSSPNGGAYRKPSVASSLGQGRKVSAASRSLTDGSPSSRKDSNFSQHVATTFGGSLRNLYLADNRLEDDIFRELSLIPELRIVNLSYNELTELPQGLLRRWPLLTELYISGNELTSLPSDDLEEGSSLRVLHINANRFQVLPAELCKVSKLSILDVGSNSLKYNVSNWPYDWNWNWNRNLKYLNFSGNKRLEIKPPGSSLSNQQQQPKHQTNLTDFTSLTHLRVLGLMDVTLTITTIPEENEDRRVRTSASLAGSLAYGMADFLGKSEHLSIFDMIVPRLKPDKVETVVGMFDGQSQSSGGSRIAKFLHENFIHTFSSELKRMRPEQHETPLDALRRAFLTLNKNMAFACYKSLDQDVRQYQEDPTDQRRVRLTKDDIDLGGVATVMYLNNMDLYVANVGDAQAILVKADGSLRHLTQNHDPAETHERARIRDAGGFVSRTGKLNDVLTVSRAFGHFPMMPAVIAAPHTMHVNLTEQDEMVILASRELWDYVTPDLVVDVTRAERRDLMIAAQKIRDLAISFGATNKLMVMILGVGDLKRREKIRTRPSLSMVGPPEEQIIPSTKRTKKPRDAPGDSRLARFNYVDAPVGELAIIFTDIKKSTSLWETCPDAMRSAIQIHNDILRRQLGIIGGYEVKTEGDAFMVAFSTTTAALLWCFNCQTQLLDAEWPTEILEQPQCQVVYDTENNIIFRGLSVRMGSHWGEPVCEKDPVTNRMDYFGPMVNRASRISAVADGGQIFVSSDFMSDIQRNLEIFADSERAASTGSEESYALDTLGHNIRRELQQLNSQGFVIKDQGERKLKGLENPEPLYLIYPHGLSGRLTTLDKDASNELAPTTISKHSQLEIQTDLIWRLWEITLRLERLCAALEYPGEARLKEPNVALFNVVKNHGGELADSTVISLVEQQVTRIEVCITTLFIRNMMRPFRPGDQLNDHAVPITDVMQQLQAQLAEFRALKEQIDASAGTATSYTYTDPQYSNGESNYDSASSSYLHMGPPSDEFNPGGPRP

SEQ ID NO: 178 - protein, 2159 aa, Coccidioides posadasii str. Silveira
MASRQRERYQAVRHGSESSSVGSRQSHDTLRQNRLSGGGRNNPSHGQQMGTENRCVLDTPPLMLTWTSHSGSRRPSSVFDDVPHAPYLSGSPDVSPTDRRSPYGFQSNRKALAVLGTSDYPVSTMPRNNPSSASNRPKPPALHAVPPSPSSPPPTSANHGTFFNDSSEFDDTSPSPRPTTSHSVASNSPDLVYDDGGRRPSIASIATGSSGGSRSTGSARFHKRLQGFFGEEYQDGASMERSISNRVPSIVHSRDRHNSLNSANTLERRPSPSLSAPRTPLPSSEVTPWEFQDFSDIPQLGDAPVREEPTESSARYTASNATVRPRHRFHLPGHRHNISKEDQSSAGSSRPSTSRENLNPSRTLKDHALGISTPMSMSTTTLGARSSSPTPSAQSAGLRDPGQLSPRAPTPKRSLFDKIRRPKGQGVSLLKHLPSSSSILQEPLKGSKRLRAEMSPGSRSRNGSVEAMGPGRQWEYIDYDRKKEPYGRSGPSKLRHGRLPFSHDSGPSKDADKHEREMFEGERVFLDTNLGDMEGIIRKPRPGSPTDTGGIFTGVDHADKNFRTVLDTPAAGDWHAPESWAVKKPSDDIVSRLPELAEDDASLSVDEDGHPYCVRVFRIDSTFATLSAGLNTTVTEILEMLGRKSFLQDDLNNYDIVMRKNDLSRRLDHGERPILMQKRLLEQAGYQSSDRVADIGREDNSYLVRFTFLPTKLGIYSSLDSELAFNENQKFSHLDLQSKSLVTIPIKLYKKAPEIISLNLSRNLALDVPKDFIQSCINLREIKFMSNEAWRLPASFSLANRLTYLDISNNCLEQLEHAELHNLRGLVSLKMANNKLSSLPSYFGDFPSLRSLNISSNNFQYFPEFLCNLESLVDLDISFNQITQLSNIGRLQALERLWVTNNALTGELGETFKLLVNLKEIDARFNDITGIDNLTQLPRLETLLIGHNSVSSFYGSFVKLRTLVMDHCPVTDFHLTAPVPTLQSLNIASAKLVQFKDTLFTSMPNLMKLYLNKNHFVTLSPYIGYLRRLEHFTMAKNPLSQLPPTIGCLTELRTLNLRECNLKRLPGEIWYCLRLEILNVSSNVLDTFPKPATSPPQLPTAEVQTNGTSASTPGLYGSPSYEELGKLEGFEARRPSQASGGYLSAGSPPPDAPRKLSVTSLGGRQQSVASRSGTDGSRKDSTFSQRMSSTFAGSLRQLYLADNRLEDDLFHQLVLLPELRVLNLSYNELTELPPGVLRRLQFLSELHLSGNELSALPSDDLEESSNLKTLYLNANKFQVLPAELCKINKLAVLDVGSNSLKYNVSNWPYDWNWNWNHNLRYLNFSGNKRFEVKPSSSYASGVGNINGTDLTNFNSLSYIRVLGLMDVTLTIKNVPEETEDRRVRTSASASGLISYGVADTLGKNEHLSMIDMVVPRFRGNSMEAIIGMFDGNSSLSGGSKIAKFLHENFPSTFASELNKLRTYKDEEADDALRRAFLALNKDLATAAHKSLDERESRHWDRVSGIGKVLNQDDVRSGAVATILYLRNMDLFVANVGNAQAVLVQSNGQHKFLTRNHDPAETSERQRIRKAGGYVSRNGKLNDRLSVSRAFGYFHMIPAVMAAPDTLKVTLTSQDEMIIMASGELWDYVTPDVVVDVARAERSDLMIASQKIRDLAMSYGASNKLMVMIAGVSDLKRRQRNKFTRSANIPMGPTTPLTDDSILLTSKRVKRPRDAPSDSRLARLDRVEAPTGELAIVFTDIKKSTSLWETYPIAMRSAIQIHNELFRRQLSLTGGFEVKTEGDAFMVSFSTATAALLWCFACQTQLLDAPWPTEILDSPACKERFDAEGNRIYRGLSVRMGMHWGQPVCERDPVTGRMDYFGPMVNRASRISAVADGGQIFVSSDFVAEIQRTLEAFADYERSSSTGSEDAWPDELLNNSIRNDLYQLSTQGFEVKDLGERKLKGLENPEFVYLMYPHSLAGRLAYQPDLSEERNEMPVPGTLGRNSKLNIEADQFWRLMKISLRLEAFCSALENPNASTLIEPDINLINAIKARGGEITDASVLNLLEHQVARIETCTNTLAIRHMMRPFRPGDSLEDHAVPMIELIKQLQAQLAEFRALKEQIDVVNSSISIPPSPNGNPIHRAVFLGNDQTSSTPTIVDLSCENCSEDSDVMCFREM

SEQ ID NO: 179 - protein, 1989 aa, Capsaspora owczarzaki ATCC 30864
MSEATRSLLRSEPLIVFQALEGKQFPPGSESSPLRAAVLLDGVEQDSTSVALSAASTEVHWLPTQAFTITAAGFTNLVISVRDEKHGLDIGSADFARESLIGESETMSESAYESPASASGAATPAALSHVSSSTSVAGGAIAAMTALNSSLSPSNSSSARSSRRLSENLDVLARQSSIPRTQQAVHDEWLFLEMPDQQPPAKVRVEITVHPSAPRGITVRVVDAQTTIAKAKGLYLSLRLMPQHAPMGGGHQRSRSIDGKDGVVKTKVSKDTSPSFNETFTFPLHLTPEAHWLEINLYEAATFSGDTQHAAGMLPLAGLAPNVTSELSCILQRKTDKKKDKADKNKRASAFGLGTMHVNYYTTFNKILPLECYQDLLKLFVPGHVGENKAAPLNILPASSKMDAASKRRRTSLIGSGSQQQQPGAGVFTLTTPAVLAFAARCAESKSFSDSVMAVFETQDLALSFLKAAVNIEVTAYLVSSSSNKNLDGFGANNSASAVTLSSGAASTLSLSSSTSTMMSALAGSTSATAPMGYIGGVTGGATVASTTLLGDLSITAQFIESYMRVVGKDYISGILRSLLRQLHTFGKIAPTKGDDMVATIRKHWKPLEAICKSVVDAVVHSLDECPAGLRLVLCHLQRLALDRLGSEMSASRAQQLADKVVNELFFTRFLCNALERPRAYGVHPSSERNVYTLVLVARILHVTAETHHLRDAREGYGFASSFMGPTRARLRKFTTSLATASGDFSLENGEMSSMAAINNAAAIDLERELANIYRLFQFSLDAASEPELSGLAGCIAVMTSESGAPDSAPSTTATAATALALGLPVLSLRAIARLEHVLSVLACIDDNIRCAKHDPTAFYLSDKAQNMMGLQVNASDAAMSSFEPADTGAELSVSPAHSRQASESTNGGAATLAASSAPSAPRSSSPTEPTASSNANQLKVGTVSRASSSHSELGSTSFGSSQNLATSEETRIGPGSEFNNRLETLIDEIVEGVRQLKANADQSKRDTFTTLASSLADSVGKVVGLINALNLEQTAPDTVATIFESREFLCDNMIVLRQAASRAATATQHREVAVQYMIDSAFVVVRTLRTLTQGIDSLDAELVTWRLEDASLGRFSTAFSRTLSRKVRSKNQLNTLEASRTRSIPAPTFAAVIAAAAAGAAGEGPAATAAATLAAALAAVSAANRPASGAAAAVATAAVAAAAASSSTLAQPSAPVHPRRYSKMVAPPTGRVTLIFTDIENSSALWERDPVLTRAAVKMHNHVMRSAMQVCNGYEVKTEGDAFMIAFQRAVDAVKFCLIAQLDLLSVNWPEEILALDGYSQVFDGDNNTVFRGLRVRMGIHTGEPDCEPDPITYRMDYFGPVVNRAARVSSVAEGGQIVMSRSAMEDCRALADELKLFDPVYVELGSFKLKGLGSEETLFQVLPLLLRARTFELAQKRRKPTNDENVKLVFNLMLDKQNAEVPPPQGHVAIVFADVQHSLQLWHAIPDAMRAAVKLYKDCMRRAIRVHKGYEVKTEGDAFMVAFQRSEDAVKWCLETQTLLLTLDWPKELLDSQYCWERRSPDGQLLQRGLSIRMGVHSGSPESETDPVVERMDYFGPMVNRAARVSELTDGGQVVVSGSVSDDIRPALDAGAFAAFVPVLTDLGSFRFKELDTTERLVQILPSALSGRIFKKLPTESDKFRPSVTARKHLSDLLGELGDSGAEAVYPAPSRSPMSTAKLERMNSINLERRLGSDEVPAIGSTRSMTLMNVKRPSTSSLLKSSQTLAYPKRPGAGSATSLPITASSSSSLASLPDSPGVFGEDTCGGCGVAVDEEGGETWLLACGRKWHYDHFGCRKCKMPFELTPYIEHKGHPYCEKDYYEMFGKRCFKCRLPIVGEMVFAIDNQWHQECFNCEVCKKNLKDQDFLSRNGFPYCEADYAAKFFASCHACKKQILDEVVSALGSRWHVACFVCQDCKTPLADQTFYAHEKSPRCQSCTLKWVKQRGKP

SEQ ID NO: 180 - protein, 2004 aa, Capsaspora owczarzaki ATCC 30864
MSVFNKIFQRRSREVIVNGKTVNPPPFDLDGNDLSTLSNISGSDDESASEGLAGNFDSEPRAEAPPTKPIASATAAATAAATPKSKGNSSHNNAPGAVVPSVAGPVLGLSSPGTSSLLLVPGEAAAGKKPLKKSGSNSKTATSPPSPAKSSSQTTPAEPLARTTSNTTSKSGRSSPAGKSGSGSGSGSGSPNLARRHSDGARLSSEFESDTLSSNGSSSGNGSLSGVPGASPNKTRHKRHASMDVLVSASTAERAAEVKSALQRKYQSIRASNGRYNPLERRRTLQLFLQNDGEGDEDNVNVHKTIPMLRPGGSERPDVEDQDNTNKWGWLTSRGFIRLYQRNLGFKTLACDLFTTTKEICLLATDKFNLGTSRDKYHIYVQLHDCAAERRLEDDEQPLLLQQQWLRDMGYDDDDALQQQGRYDHSHMFRFLFSNTSTAMEHSWEHMERKFEAFVLGIGVSNTHVKSMSKLRPSLLLQYTDELDLSNHSLGTLLHQETTTLSSLLLNSIIQSSLGKLSLSGNVLPFVPKEICSLHHLTALDLSNNILADLPVELPRLTRLEVLNLSQNAFSTLPLVIGGLQRLRVLLLADNRIHTIPTELSQLQSLEKLDLRGNSLVSLDPSLMAMPSLKWLNITNNKIDALPQAPADKPCVIQHLLCDSNMMSIARIFYPNLHEVTLRQNNITVFAPPGASLACLSKLDLSANKLISLPDSIDRLASLRFLLLDNNRLTRLPNTLTKLSNLETLSVTRNALTSLPDMISNLRRLKHLLIQVNNLTHLPEELWFLPQLVLLNAGSNLLQYLPDLEIYAAHQRAASSGSSASFSASTAAPSIPSNAATAGGDAGQDATRQSTASLASNSTKPSDGTAGGGDSPQSSGTTTPQQQSGGEPVPAVTVTIPQSTSAPSLSTPSSTTVPPAWDASNPMSLQLRMAMLMKLVNEKSDSPVALLPTPCTVVGNCPTSPRHEGHVRLRSMRSLPPVTEGENFRMSMLRGSSSSSGGQFGTVVRRTSMGSINSRYSTISSVAFPPEGGAPPGAFPSYVDENATDARKSGIFGTKSRKELRDQQKALERERKEREKRDKVDKKGQRKGRPTLDVAGAGGSGGTLRADGSGLPIDELDEAAEQQQQLDDIYSDDDTWPRLRELYLGDNKLGDDCLEIISKLKNLRVLHLGNNALMEIEGLGKLRKLRTLCLSGNDIAYISEDIENIKYLHALFISNNKLSNLPTELSKLKYLWTVDARDNNLRWNLRNEEFDWNWTSNPELRHLDISGNKRFIINDPNVDFFGMVKLNLLGLEGVQVYNDFPEILRPALRMVKEPDTKVGARFARFDFRSGLAEMRPGLYQAMRPRAASVSNSLASIFTPPAGPTGAHAGTVRSSSAGQAGATPNRRSHSNSSSSSNGNGKSGAHSSVRHHSAASPGAITLQEFFAGDVSSAGGHPERHSGAGTEPCTEFLRIDRYRNRPRLALFGLFDGHRGSEVSRFVRENFLAVFEEEMGKCNQDAIRGLRRAFLSLNRKLGVLRLGKLCGSSGLVVFLDKDKLYAANLGDSMAVLCRSGKAKLLSVKHAATTMDERERIKSVGGAVSDDARVFGAVDASRAFGDFFWAPSVNCNPHTTTEPLTQEDEFVILACCGLWDVMTPQMAVDIAKSEPTPSKAAQKLRDFAWLYGARDSITVMVVFTPSSARLRKNRDGKSALQQRGFDGVPTSVADLIKAPVGKVTLVFTDITNSLVLWELYENAMRQAVKDHNDLLRKLLRLHRGYEVKTEGEAFMVAFDNPMNALRWCLEVQLQLLEVPWPEDLLATDDCKEIRIAPSKRAPISAAAARMTETSSPVLGRKSVAFFDSVSGSTSSSPVHGGQNGDAAPVERVIWRGLRVRMGIHTGNPDCEPDPVTGRMDYFGPTVNRSARVTAVADGGQIVVSSSAWEELEGDMPHFEDTAVANLGSFELKGMEKKETIKQILPARLVDRSPFFMHPPRPAEPVAVAASSPHRLHSTPSFSSATQLSHSPQK

SEQ ID NO: 181 - protein, 1764 aa, Capsaspora owczarzaki ATCC 30864
MASSVAKASPVSNPGSANQTGSASKLIKDHYIDIKVVEARNLPGLLNRNEAGRTPHISAGRRISLGRMKDAAPSKGNSNPYWGTDFHFELFPEFHDISVVVWDARRKADIPTGQVSIPKAVLQARTGHVPVEQWYKLKPATDEDRLLGDIHLQIVFVPAASSGGDQATADDASAGVLRVKVLEARDLFYGGRGNSGTMKRKITDINPVVSVALISPVPGASPVEHRTHQFKANDAPTFDELFEIPVRNADLLSSLHVTVLTTPSGKSNHGTIGPGGTVSSLSAVISRGEAAMGRIVLPLASLERGTVYDHWYALYPAIDAGNGSTPPHTPGLSPSPATSPLAPSYPTPGETSSGSGPTRSNGSPAPPGLDEGPMIRLRLSYIEEGVLPVSEYSEFVDFFLNNRRQLVLALDGVTRDRSETGQRILDLIGTRRLTRSFLKEMMEVQFRSAIGTTSSIVQNASLATKVIELHIRNIALPYVRAVLKEPLDEMILEDKYCEVNPFFVDKTTNVKKNLQLLAEYATRVMNAIMSSGKQFPTPLRQVCADLRHCAAKCFPSDPNVRYSAVSAFIFTRLLCPAMMGPKAFHMCADFPNERVARTLTLVAKTVQMLGSLTEYTDKERYLLPLNRVIEDNTSSLKAFLDMVAVEPRSPSATTTEEFSVSPSSGSASLSAATGYSLSVGASLGVSTPVLSADQEVAKAAAALFRHLWSLREAIEEMNDRRQDDPAFDTSRQLLQILDKLYATHVANHAMVRPLAIAGNIDLRHVQLPSALLDAAKEHSVTVAKARKRTISNNTSEIHPLVFGGAQSNGSSATNHESDASDVERTSADLLEHLTSTIAQRIAALLAAANAGNKAQFVNIASDAEVGVLALLAALTPRPGTKETSTSSTQLAAFNAARGTLLQHVQALLDQARTASAEAKDAPSDEAALKLMMAHAQNVLSSTRETVLTLIAVPKSRSPSRARASAANAAMPVSVAIAASASRPHGSVANSSSRSPAPVAELFDGASSASSPVGAASAPTETSTSYARQLDDICQEVEPPTGEVTLVFTDIQNSTAIWESDASAMRTAIKVHNNIMRRCLRRHKGYEVKTEGDAFMVAFQDPVDAAAWCMAAQLELMDAEWPQVTLSFAGCGEQRTANGQLVYRGLRVRMGIHTGDVGFELDDITDRMDYYGPNVRRANRVSSLASGGQIVVSGAAWAQLQPKLRTETLAPFHAAGKPLGEFKLKDLEIQETLVQLLPGTLSERAFPPPGTAAASPSATPGAGVHSGVDALQVRESAGHGAPRRNSKYYEMLQKISPEVSPPTGTVTIVFTHVAHVTELWEANHTAMYNATKIHNDLVRTSLRFQHGYEVRTEGASFLGVFQNVVDAVQWCAILQMKLVAATWPSDILDMEHCKQVRSSSGRLLFSGLRVGIGMHTGEVGCELDNVTERMEYFGPAVSRATLLGNMADGGQIIASEGTIKALQACGSDITEQLEVRFTFAGEVVFKGLGSERLTEICPNLLSGRQFVLQPGTSTLVAERSSSGNFDDVLRAIKNFDAKSSRTPRHSSSSATALKPASSSLSVTFGTGYATLSSSIPSLAAGNSGAMSFVCHDCNGAIGTGTEWISAIGRVYHKEHFVCHQCKQPFGSGRFLDKEGRLYCEHDYEALFGRVCAGCHVAIASGENAINALGRSWHADHFRCTHCSEKLESKFVVLDNLPYHKHCAESGPANACSGCGKPIDGTYTNADGQKWHNECLKCRHCSTPATATDMFIQNGKPICGKCQAKP

SEQ ID NO: 182 - protein, 1635 aa, Capsaspora owczarzaki ATCC 30864
MSGNSTVAATPSAAAAATAGNGTAPAPGAAAAPTTTTTTTTAGSGGSGGTLSGPPTELKHSSSVLATVSASSLFSKTGSISFGRRSSRSHTPLEFAQLRADENASTTTTTTTSTAQTAPSLAQTTSTTGSLLNMSAPASGAANAQATAQEHLTPEQQGRLLRSPPTIRRRLLSIADPNSALLPHERAGIAASTSGSGLAAAATATATASPAIAGSASVSGTAPSSVGMPLPNGSASTSAAGSAFGGSSAGDGSVEIKLWRRPRGLAQLRRRTVSVVDMLPAFPDVVSSASPTMRHALPAGAYASMVASNGARSESGLSPVTSSSSLASASSSTTTFSAPPAHPSPSQTRVKSAHYPLSSSHLPTITESTASLNVAAGADSAVASSIGNSTAADAAAASESVHGAHAGPGSSLSSSNSSLSSPREALSLTAIATDNIPPITQPDGASDPQAEEPAAQDDAPADRFVESSIPQRGKWRSLTSLSVMRVFMRNNPKFKLVGCDVNATTRQLCEMIAKKFGILSDSTNFRLYVQRDDMERCLQADEQPLLLQKEWLIDLGYREEDNLLQLGKYDFSHLFKFIFSDEESAREESSSLKNRVMKAFRALDTMEVPHLDLSSLDLGGFMQGTLPGEVETFLSLLADSLPSLSLAHNSLRTFPEEVSELVALKHLNLSNNLLRGLPASFAKLAQLTSLDASYNTLLSIPAPVCQLGRITSLNLTGNFLTSLPEALFSIVGLERLVLRQNRLTSLSGTLNHLTFLRHLDISSNNIDALPPNLQLPSLEELLIDRNAVSVLVVSWPCLTVLRASHNKISSVIFPCDLVDLRCIDLSFNKLSVLPDAFACSPLLRVLLLDHNKLRALPASIMGLDVLEALSVEFNRLTSLPEEWVPLRSLRHLSVLGNNLSALPDDIFRMESLRHLNAGSNVLQYLPSVAEMDESEEEMWLNAIDPSKMPAIEEIEFEAVNQTLQELYLGDNKLNDSCLPILSQLTDLTLLHLGYNALTEIPPKTLGRLSKLRSLCISGNDIVYLAEDVQHMSALEHLYISSNKLSNLPAELGKIRNLAIVDARDNNFKWNLWNQQFDWNWNWNRHLQHLDLSGNKRLVINDPKKDFVQLVNLKSLGLERVKVAQNLPEELAKIASVEQSVAKGVSSASSNVWRSGVAHLYGINSENFKIDTVRQYNFRDNADEALFAMFDGRGGSQVPEQLARRLPSLLKDQLIVTNSDVLRSLRGTCLGLNRLLGGQDFAQLAGSSGLILYISSNKLYLANVGHSMCVLCRNGRALVLSPVHLLSQSDEERHRTRLLGGFIGPDSRMNGLVSMSRAFGFSFLQPCINSSPDISTVELTDDDEFVMIGSKRLWEVVSPQAAVDIIRNEHTPSKAAQKLRDFAWLYGGRANLSVLVVFTPKATIKSTKRARRATNIDSQRILSRLGEEVAPPTGKLTLVCTDIKNSTMLWEACEEGMRDAVKNHNALMRRLLRLYSGYEVKTEGDAFMVSFEHAIDALRWCLTAQIQLLEMELPQEIRSACREENGPDGELLFRGISVRMGIYTGLPDCEPDPLTGRMDYFGPVVNRAAAVSSLADGGQVVISDSAWQEVSERLDELGEGLAPPRVDDLGLIKLKGLETKENVRLILPPSLRARTF

SEQ ID NO: 183 - protein, 1690 aa, Ogataea parapolymorpha DL-1
MTGIANKQQILEHDSEFPTNHSIPQFNSKYTAESFGASEALTSSAQRKNKSQESSPLASPTTSRRSSRFPSVNPVSPSSSSLALNQDAQRTSHTSSVHELSDNGSRRPSSSQGDIGVPPSYKEEPSRDLFLQQVPALAASDKKASPFNLDLDTDNEQMADITRLSNSRLSRMGSTVSMIPQPPLERTEWRPPESWKVKNTRENSDPLTHYPGIQERTSSMSSSESSTASSGRSLVPPRKASAITSPSTSSPKSDNHLDGHREKRDSKSTITEDSGRVYHAKELKGAARSSVRIFIGDKSSVLPCTLDTTCKDVLDSLHRKRFLKNDEDHIIRTMLFLYGYTQRDNLDYIERTDLSFLFKFVVQDRGVELISNERRRMINPQNVNLNNWNLQDIPNFLYAEPIVSLDVSQNPSFEFTKEFMHDCRNLLNLSFTRSGNPKFPTPVVYAPRLQELNLEVNYIKLIPPEISKMTTLTTLNLACNRISTLPASFAELQSLQSLNLSSNRLKNIPEPLTKIAGLKRLDLSYNSISEIPDSVSNLVNLEVLQLAANRLSRDLPSFFRQLKTLIKIDIRFNKFDSIDALKNLPALEVIRATGNNISVFKSSAANLFEVELNINPVTLVKFDQVMTKLKIVDFSKDKLTSCSFVSMLPAIEKLTMDYNHLVSLPDDIYKMKNLTHLSVFRNNLTSLPSAIGSLTRLRYLDLHLNNISFLTPEIWNLSSLEYFNISSNLLEFFPDPPEQFVPFTGFSSLGRTATQRARNHQSSIVAPSTKRRTSEISTMTMSNYDSVGLEKSLKVLSLNDNKFTDSVIQTVSMFKNLVVLNLSYNELFDIPPGHLNNLTKLQKLYLSGNHLSSLPVDDLEAFTQMDTLHLNGNRFHTLPAELSKITNMTALDVGSNNLKYNIGNIPYDWNWSYNPKLKYLNFSGNKRLEIKPLHKREGMEDSLDSFLVLKDLKLLGLMDVTITTDLVPDQSVDVRVRSTVSQLGKYGYGISDTLGNKSSLTTRDVVIERFRGNSNEKLITIYDGKNCSDESGDKISKIIQETFEIHLAKELEGQDSGKTIEDALRAAFLTMNSEMSILINKDKSSTFSSAAAHRTTTTDELTMEKDGLTGCCATVIYIRGDELYVANIGDIMGILTKADGEYSVLTIKHEPYAPEEYARIRESGGFVTTDGYLDGVSDVSRAVGYFKLIPHINAVPSISKYKLTQNEEMIAIATSEIWKKVPYDLAADIVRQEKSNPGIAAEKLRDFAISYGVSDKATAVVLSLRQFTTKQKYHERGSLPEDSLLRKLDEEIEPPTGELAMVFTDIKNSTLLWDTYPVAMRSAIKVHNAIMRRQLRIIGGYEVKTEGDAFMVSFPTPSSALLWCFTVQSQLLTTDDWPAEILASDQGCEIKDEEGNIIFRGLSVRMGVHWGRPVCERDIVTKRMDYFGPMVNRASRVSSVADGGQIAMSTDFYYEFEKLRNLHEQVKSGAGDISQVYGSKTLGQILESQMNQVDQIGWVEESIGSRKLKGLEAPEKIWLIFPAHLAQRLKLLTRTNGEIDNRAGKLLMGGLTAESVWRLRKLSLRLEKICSFCAGSTTQLISNKAKILPSDLISSSAEETFINQIANAEMDLLLFIEHIVTRIENAVGILTVRKCASPEEANGLLMGTMDELYRAMHLMVHQAEEAARAKSQLMEELPEELSQDGAELVN

SEQ ID NO: 184 - protein, 2297 aa, Grosmannia clavigera kw1407
MPRHEPVSHVSSLTSSSTDSGRSATTVKPLPSKPSYSTGPVSPDFRAIMHSPSISSRRGPPSRLQMDENGNLRRMSSGKEDLQVSPTIAAQRGSIMSPTPISVKAAHRENRVDFGNYRHDLAAIDFSSGGGISDGTASTAGSSSRGGAPQIPHIPSISNTGLHQVAPWMAGISSAGGSVSAPSITNTPHSTYYDDSSENVSVASPLSPPLRSGSSRQVQNPTGSESPEALYYGDERRPSIASVATASSQGSRASDRRGGGFRKLQGFFGEEYPGRDSSETSLNTKEQRSHSHSHGRPHRDRNYSNATDHTRDASPASSRPRTPVPAPEVVPFLYQEANDIVKYGEAPVRNILSGPDRDRYVTDALSQIPPKTSSSSRSAHSIAHMPHHRHNKSNDDPRSLRPTISREDSLANMRERANPSFSSARPRAQSPTPSGHSGSTIFGPSKSSSIAEGQISPSGHQPKRGILGRLRRHKDKDEGLGMAGLSTPAKLVSYSTQSLLSRPLRQELPRLDGGPLLFGSDLPQRYYGNAESAASIRSGISSKQATFNNKFPFSKKPRTPRHTDDQEEMIGPTDRADGGTRFYLDTDLNNMDGNLGRPLPLTPMDVDFLRGVEADKANKNTARVNHYYNKNAASARAAPVNSTVNGTRSSSEKSSNGPGNPAGEATGPNGAWNAPDSWAVRRTDELHQGPETDDYGSPPRPEEDAVIYCIRVFKSDGTFATLPMSLNASVQDMISVMAKRVFTESQNYQIVLKRHDLIRILGSGDRPLIIQKRLLQQVGYEESDHLGDLGREDNSYLCRFLFLTAHDSDFQTKVDIGLGRMPKLNHVDLSGRNLITIPISLYKKASDIMSLNLSRNLSLDVPRDFIQSCVNLRDIKYSNNEVRKLPPSLGRASRLTFLDVSNNRVENLNNAGLEEIVGILKLNMANNRLKQLPSYFGAYRSLRQLNISSNFLDKFPGFLCDMESLIDLDLSFNLIDSLPDEIGKLRNLEKFVITNNRLSGSLPVGFRQLESLRELDVKYNAITSIDVISDLPKLEILTADHNNISQFVGSFERLRTLKLNANPITRFEIKSPLPTLKLLNLSNAQLASIADSFNNIRNLERLHLDKNYFVSLPNQIGNLGRLETFSIANNSVGELPPEIGCLMELRVLDVRGNNIRKLPMELWWANKLETLNASSNVLDNFPKPASRPPQVPGEPVTKDSMSSGASRLNSTVGTLSSKPSSEELSVDDSRRPSQASSTLLSVGPSPVPSGPDRKSSVVSVYGKGGRKTSVVSRSTAQTGGSSTPTAISRKDSGLSSRITNTFAGSLRNLYLADNQLDDDVFEQLALLGELRVLNASYNEITDMPQRSMTKWPQLVELYLSGNELTTLPADDLGEYSMLQVLHINNNKFTNLPADISRAKKLAVLDCGNNSLKYNISNVPYDWNWNLNPNLRYLNLSGNRRLDIKQTTFGSTARPTESYTDFNRLLTLRVLGLMDVTLTQPSVPDQSEDRRVRTSGSMAGFLPYGMADTLGKNEHLSTIDLITPQFSSNDGTKQDTLLCLFDGQALSSGGSKIAKYLHENFGRVFLSELKVLKPAQHETVEDALRRAFLTLNKDLVTSSIQADDRMPLASTKVHRGSVASMVMTKEDLNSGGVATVVYLQGQELYVANVGDAQAMLIQSDSSHKILTRKHDPAEPSERSRIRDAGGWVSHNGRLNDMLEVSRAFGYADLMPAVMAAPHVTHWTVREQDETVVIATRELWEYLTPGLVVDIARQERGDLMRAAQKLRDLAMAYGASGKIMVMMLSIADLKRKAERSRLHRGQSMSLYPLSLQEETSQFLPTRRGKRTKGEVLDSTLQRLEAEVPAPTGLISIVFTDIKSSTNLWETYPAAMRSAIKLHNEVMRRQLRLIGGFEVKTEGDAFMVSFPTATSALLWAFVVQLQLLEVQWPTEMLNSTSCQEIMDKDNNVVFRGLSVRMGIHWGEPLCEPDPITRRMDYYGPMVNKASRISSVADGGQITVSSDFVSEIQRCLETYQESPTGSIGSSEDPAVGSATGAGIGGSGTGSTAGASSAMMGFDDDVFAQAIRKELRALSSQGFEVKEMGEIKLKGLENPEVVYSLYPHALAGRMDAHQHHERLAAAVAAASQEAEGQAAAGPVMAVPKTINLGDPDEEVLRSIPEAVWGLWRVSLRLEMLCSSLEEAGGCGLQPPGTELLEQMKQRGANVTEEFMISFFSHQVSRIETCVTTLTLRHMAIGGGPIGRLDDLRGPMADVFASFQHQLAELQQYRTRYGSIELVDNAGDADDAHDAHDDDEGSDTEQE

SEQ ID NO: 185 - protein, 2273 aa, Cryptococcus gattii WM276
MPVFRRSASSHSTSEAPAPPSITNVSDGSPASTKSVTRQGRSRSHGEKGSPASTFSSRFGISRHLSHHSPQPHEHEQGEVPSPSTSASRDIPVSLAPEIGSSEAEDASNFGQESAGEQQLVPETGPSSPRTGRSSRQPSVQATEPSSEDETTPPEKRRVSPLMKRLGEEPPFMLPHPSCSDSTYQAYPGVVIGAFAGGGPDTLFGKLEGIMDDILDPNAAKQDSRGSQTPAGANIAPWLTDDGPPSRSQNSSPMSPATHEKPIKGPAAALREKDLRKHSSVLNHFASVPSLPKIRRHGTAETATPNQTPRGSTHSQLYLASSSSSVNNENCESRATSDDSIQTTLTQKVRRHSPEEMGHSSAVPPSSKGTRPGRFGSTASTVSGSGSIGEKKKSLLGGFLKRKTNPNLSLNPISHDFAGSEHRGSAGSIPLSASSSKLSSGSLSSLPSKSPPFTSPPEAFSRPFLPANYVHEGAVSPLQEINESPFHLDMNLDDMEGIIDPAKAGLPSTVAYRPSASSEITTDSSASESMRLDEALNQTSSFGTSVSGASQGSDGTKMPGRVVLGEAERLSAPFNEIDPFQQHHRESASTTGSDGKHFTPPSPHTLSPKHHLPPTSANQPRRPSALRNVETGQVDESPQLSHPEGSIQPISPSWTLGSGMTVFNDPFSSSRQRQEQTPNTASLSSSTATYPSAVAGPGPSTSRFLATAAPATASATWAAPESWGVEGDEAPAEETSSSDEDDWAGVGVEEVASASPTSDTLPSPAASPTASPKSSSPPSSLKKAPPFGFKSQQRAKPGTSGTTGSTASASRKKKGKRVGSSGRTATGRPGTSGSAYSPSSLHWIRIYCADKSYMLYNLPLNTSTGELLALLATQAEQGMIRGKSVAINMKLYICERGQDRMLLPSEKPLTIQHRRLLQLGYTEADHLDELGKNDMAMLCRFIYQAPILPTMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQIKSLKYLNISNNKFETFPSVVCEMSNLVDLDVSFNNIAELPAKMSDLKSLEKLGLYSNDISKFPESFCTLENLRILDVRRNKITDLTAVYALPNLATLQADNNNIVTLDAQLGANVRQFSVPHNSVTRFTLAPPPNMAVVTYMLTNLDLSYGKISTLADEAFSGLTNLVTLNLNFNQFTKLPATLDRLTKLEVFSCTDNMLNAVPAGFGKLQRLRVINLHNNNLKSLPEDLWACGALEIFNASSNLLDSFVPPPADIESVVGRVGSGTSQTSNGRKKYNVPPVGLSIRKLFLADNRLNDDVFHWISLMPCLRIINLSFNEIYEVPPLTLCKCDKLEALYLSGNKLTSLPSEDLETLQSLKALHLNGNKLQTLPSELGAIKTLQHLDVGSNMLRYNIANWPYDWNWNWNTSLRYLNLSGNKRLEIKPTSAHEMTHASAFRKELSDFTALTQLRVLGLMDVTLRIPSLPDESDEKRVRTSFSDINNMAYGISDMLGTIDNLAMFDLVVPHFRGKENECLFGMFGRATATMQGGKIAKHIQEIFSETLTAHLQKLEPGEEPSEALRRTFLWGDRKAFEYFSGKLQLEKERKPSWTSFASFDSMLRGWTPGINSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQYCSYQTAVDIARTERDDPMMAAQKLRDFAISYGAEGNVMVMVVNVSDLFPVKGGRARGPSEQAAADASVDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVRDSNGTIVQRGLRVRMGIHWGAPECEKDPITRRMDYYGPMVNRAARINASADGGQLMASQDVLNEIAPLMEYLNSNDEQVLNDLQGDLNREVMELRRIGLELRDMGDRKLKGLEVPERLHLLYPKTLAGRLEISNEIRAEVEVNDARKAAERQRSVDIDQVCQLSDIALRLEAVCSCNPTPSSPGESPKVMRLHPPASYLGPTIREDMNDEELWTIIESLVGRIENAMSTLYLKNLGEFSTILAALESATKIDQKLIVHALALMNKAMEKDEENAL

SEQ ID NO: 186 - protein, 2168 aa, Metarhizium acridum CQMa 102
MTDNEAVSRISSYTSASASTDSSTRSSLTAMPSTPPLASMSARRASSMRITTDGGGYRRRTSKDDVQVSPTSTTATRGTLSPPSSNSASNIPAKDRRLSDLTNYRRDLAVLEPTRSHPPASSSSSQLLQPQHSHSVGSLAATTQIAPWMSSALPAASSPKGLSTSFYNDSSDNLSLASQLSPGLPSATGRPGTGSGSISQDYADALYDNMDGRRPSAASIITTASSQGSKTSVNRGGFRKLQGFFGEEFPGHDSSESSLPISVPGKDQRSRSYSHGRPTQRDRNYSNATDREPSPSSSRPRTPVPNPEVVPFLYQDNTDIARYGEAPVRDILTGPDRERYESSAGQNPPKSSSSARSGPVHHLHGHHHRHNKSNDDPRTLRPIASREDSLGSAQHGRDRGPSVGMLNQRSRAHSPTPSTNSGPPGSRSGLHADGSTSPGHHGKRGILGRLRRHKDKDDGASRLRDLPPSTRSLQVKSSRADMQRPDIFPGYYPGTPEPGDTLDPRTGAHRAATFNNKFPFSKKTRPQRPSDYTDEAIGPTDYNDPGHVYHLDTNLNDMEGILTKPPPLTPMDSSFINSIDGDRRESSLEGPKGRWDAPDSWAVRRNTEDNTEDVPEVDEIGSPPRPDEKLTSYFIRIFRSDGTFSTHSMALDSTVTDVISQVIKKTYVVDGLENYHIIMKKHDLIRVLAPAERPLLMQKRLLQQVGYEEKDRIEDLGREDNGYLCRFMFLSARESDFHAKTMDLGISRSQKLSYVDLSGRNLVTIPISLYKKAADIMSLNLSRNLSLDVPRDFIQSCKLLRDIKYTNNESRKLPLSLGRASRLTYLDVSNNRLEQLEHAELNSLIGLLKMNLANNRLTHLPPYFGAYQALRSLNISSNFLDKFPPFLCQLHSLVDLDLSFNAIASLPDELGNLKNLEKLLITNNRLADEVPEGFRQLLSLRELDIKYNSITSIDIISELPKLEILTAAHNHISSFVGKFETIRQLKLNSNPLNKFEIVEPVPTLKTLNLSHAQLASIDSAFSNMVNLETLVLDRNYFVSLPQQIGTLSRLEHFSIANNSVGELPPQIGCLTELRVLDVRGNNISKLPMEIWWANKLETFNASSNVLDAFPKPASRPPRVPGEESTGPPTVQNGKPLPPNPIPSTPSSEDLSDERRPSQASSTLLSVGPSPVLATADRKSSVVSVYGKGGRKTSVVSRAASQATNSTTPPPTTTRKDSGLSSRLTNTFAGSLRNLYIADNRLDDDVFDQIILLSELRVLNLSYNDEISDMPQRSIKNWPQLVELYLSGNGLTSLPADDLEESSLLQTLYINGNKFTNLPADISRAKKLAVLDCGNNYLKYNISNVPYDWNWNLNPNLRYLNLSGNKRLEIKQTAWGGPDGPGAVNREQYTDFSRLLNLRILGLMDVTLTQPSIPDQSEDRRVRTSGSLAGHLPYGMADTLGKNEHLSTVDLVVPRFNSSETEMLLGLFDGQALSSGGSKIAKYLHENFGHIFAMELKAIKNRPDDTPTDALRRAFLGLNKDLVTVAVQHTEERSKAAHRGSAQPVVLSKEDLNSGGVATVLYLRGTELYVANVGDVQAMVIKTDGKHEILTRKHDPAEPSERSRIREAGGWVSRNGRLNDLLQVSRAFGYVDLMPAVQAAPHVNRMTIKEHDEIILLATSELWEHLAPGLITDIARSERQDLMRAAQKLRDLAMAYGASGKIMVMMISVADLKRRVERSRLHRGTSMSLYPSGIPDDTQVLSTRRRGKAKGDVLDSSLNRLEAEIPAPTGNVSIVFTDIKNSTTLWEMYSSAMRSAIKLHNEVMRRQLRRIGGYEVKTEGDAFMVSFPTATSALLWCFAVQMELLDVSWPSEVLNSMSCQPIYDKDGALIFKGLSVRMGIHFGDCVSETDPVTRRMDYFGPMVNKASRISAVADGGQITVSSDFISEIQRCLENYQDTERNSSGGSEETFEDESFAATIRKDLRSLTSQGFEVKEMGEKKLKGLENPEVVYSLYPHALAGRIDQHQQHERRDEGLDRPAILAPGSELSFDPESIWALWRVSLRLEMLCSTLEEVRGSGLQPPETELLERIKSRGGEVTEKFLLNFMEHQVTRIETCVSTLVMRHLALGQPIIKELNDLRGPMSLVLDYFVKQQQELARYKQSYGDLPLEGDAAGGKTQRAIASAEEIDY

SEQ ID NO: 187 - protein, 2003 aa, Trichophyton equinum CBS 127.97
MALGRVGHGPSATSSPMLPSDGNHQQQQPQQQKRTFYHDSPELPPSSSFDPFSRSNNLRPDEDEDDGDSLRRPSVASATTVGSQGSRSHGGRFHKRLQGIFGDEFEQQDLSFPTTLRSSSRLSSSRPRTGSAGRARKGSTNSLSLDRTASPDPARPRTPIPSSEVTPWEYQNFRDIPNLGEAPVRQAPTTDPSEHQPPAPASKVRPTHRLHLTGHRHTQSKEDLPPNTANISTPLPPRPASGRDEIPPLMRQSREHSLQAPTPMSSSTTLGGRSASPTPSTRSVNPRDARDQSSNPSAPKRSLFDRIRRPKASSNSLKNLPSPSKSAQDMAKAASYFTSEPGSILRGRKGSSESTSRENNDLDRRKEGTTSKALSAIGPSRLRHGRRLLDGKGARDRRNKADNNQVFLDTNLGDMSGIVTQPDAISPTDTSVGVFGGSKPFPANGETITPLDLIGTDDWHPPDSWQVKRPTEDTGTRLSSVADPGPEKEVDEDGHPFCIRVFRIDSTFATLSAGLNTTVTQLLEMLGRKSFLQEDLNNYEIVMRKNDLSRTLEPNERPILMQKRLLQQVGYHMSDRITEIGREDNSYICRFTFLPTKLGVYSNLDPELGFTDNQKYSHVDLEGRSVATIPLKLYKKASEIISLNLSKNLALDVPKDFIQSCINLREIRFTSNEAWQLPPSLSLASRLTYLDISNNRLEKLEHANLHKLKGLVSLKMANNKLSSLPANFWDFPSLRSLNLSSNNFRALPEFLGNLTSLVDLDISFNQIEDLPTIGQFTSLERLWVTNNSLSGPLVETFKGLTKLKEVDARFNNITSIDNMASLPRLETLLVGHNAVSAFSGSFPRLRTLVLDHCPVTEFDITSPLPTLHSLNIASAKLVEFRDSLFANVPNLTKLILNTNHFVTLSPNIGSLKKLEHLNLAKNPLSILPASIGCLTELKSLNLRECNLNRLPAEIWYCLKLESLNVSSNVLEIFPKPASSPPLPPSEATNNLTPMGTPLLRADSYDDVGGRSEEYDFRRPSHASTGRLQVGTPPDSTRKGSIPSMSSPGGRKSSNASRVTAESRKDSTFSQRIASTFANSLRQLYLADNRLEDDIFHQIALLTELRVLNLSYNGLTDLPPGFIRRLQYLSELYLSGNELSSLPSDDLEESSHLKVLHLNGNKFQVLPAELCKINKLAVLDVGSNSLKYNISNWPYDWNWNWNHNLRYLNFSGNKRFGINPSSAYTPSTDGTPSTDLTDFSSLSYIRVLGLMDVTITIPTIPEETEDRRVRTSSSLSGCIAYGLADSLGKNEHLSMIDMVVPRFRGSDMETIIGLFDGQPSMGGGSKIAKFLHENFTATFMEELGKLRKQHGETPEDALRRTFLALNKDMATAAYKPVDDKESRHWDRNPTAAKLLNREDAFSGGTATVLYLQNMELFVANVGDAQALLVQGNGQFKYLTKNHDPAEASERERIREAGGYVSRNGKLNDQLSISRAFGHFHLVPAVIAAPSTVKVTLTSQDEMIILASGQLWDYVTPNVVVDVARSERTDLMIASQKIRDLAISYEALAYQDPRRLMTNICSLFTKRAKRARDIPSDSTLARLGHVEAPTGELAIVFTDIKQSTSLWETYPLAMRSAIQIHNELFRRQLRLIGGFEVKTEGDAFMVSFSTATAALLWCFTCQMQLLEAPWPTEVLQTPSCRETYDDDGNLIYRGLSVRMGMHWGRPLCEKDPVTGRMDYFGPMVNRASRISAVADGGQIFVSADFVTEMERTLEAFADYERTNSDSSEDTFGDEALGQATRRELYQLSTQGFEVKDLGERKLKGLENPESVYLLYPHALSGRLSVQPDMVTSGEASSPGTLGKNSTLNIDADMFWQLLRIALRLEAFCSTLENPGGSMLLEPDLQIINAIKARGDEIDDAAVMKLLEHQVARIETCTNTLTIRTMMQPFKPNDTLLDHAVPMSDILQQLQSQLAEFKALKTQMNLTGAPTTPPPSGYSVEVPESTISSAQSSAINLAAPPHLAPK

SEQ ID NO: 188 - protein, 2144 aa, Ajellomyces dermatitidis ATCC 18188
MARRQRTRDRELRQGSESSSTGSWRSHDTARQGSQSHDQGQGPADVRPTPVRSSGQEPRLRPISKYRSSSRSNRSVRSSSRRSYSPDISPTDMRSGFSSHRKTLALLGAAGYPPPYFPDPPRPPLRRRSPSWTPPPSLDRNALKPSGAPGTFLNDGSDQEVSPAFPPAATARTGGSDSPDDPMDQDHRRPSAASATTVSSQGSKDSTGRFHKRLQRFFGEDQGNMSDSALSHPPKVRERNNSTHSLNPITRSFSPHGGDGPRPRTAVPSSDVAPWMYQRINDISNYGDLPIHGDPTDPDLARFTGTTEEQNPDKDSRRKKTARHRHSRSGEEKSVYLGTEFPHIFGSSDQENPKPAFSYLKNGALSPTSSSGTFGARSTSPSPSVRSGHGQRSPGGSSNKRSFFTKIRRHPKVPIASSLRHIPASSKAAHEGSSKGAKFLRRDDSPARRVRNASFDSVTNPKPWEMSDSDRKKDNLGKGASKFRHPRFPFGHDGGHKYHDKNRRNTFEEDRIWKLDTDLSNLSGIVAQPRPISPTDSGGIYTGPSQPEERKNKKEFQNPFDAHVAGDWHAPESWAVRKAQDDILSRLPELPDDGIAVDEEGRPYCVRIFRIDSTFTTLSATLNTTVAEILEMLGRKSFLQDELNNYDIVFRKNDFSRTLDYGERPILMQKRLLEQAGYQPSDRIADVGREDNSYLCRFTFLPTKLSGYSSLDTDLGINESQKFSHVDLSGRSLITLPIPLHKRASEIISLNLSRNLALDIPRDFIQACINLREVKYIGNEAWRLPASLNLATRLTYLDVSNNRLEDLDHAELHKLHGLISLKMTNNKLSTLPANFGDFPLLRSLNISSNSFSCFPEFLCNLKSLVDLDISFNKITELPNIGKLTTLERLWVTNNGLHGPLDETFRDLVNLKEIDARFNSITSIDSITQLPHLEHLMIGHNAVSTFSGMFPKLRTFTLDHCPVTEFDITSPVPTLTTLNIASAKLVQFKDSLFANIPNLTKLILNKNHFVTLSPYIGTLRKLEHFSIAKNPLSTLPPSIGCLQELKNLNLRECNLSVLPEELWYCCKLETLNVSSNLLDSFPKIGDSPPIPPNELPVNGGTPVTTPGLSSPDFEELGKLEDFETRRPSYASGGLLSVGSSPAGSHTNRKCSVVSLNNPASAARRSSIASRTPTDQASSRKDSSFSQRISLTFAGSLRQLYLADNQLEDDIFQQLVFLGELRILNLSYNELTELPQGLLRRWQHLVELFVSGNQLSWLPSDDLEESSSLKVLHLNANKFQVLPAELCKVNRLGVLDVGSNSLKYNVSNWPYDWNWNWNRNLKYLNFSGNKRFEIKPTTSYASGSPTGHGTDLTNFNSLNHLRVLGLMDVTLTIPTIPDQTEDRRVRTSASLSGSLTYGMADTLGRNEHLSTVDMLVTRFRGNNCETILGLFDGHTSPNGGSRIAKYLQEHFTSTFTDELKKLRTGGGETPLDALRRTFLSLNKDIATAAQRSMDEREQRHLDRAGPPSSKLLTPDDYTSGGVATIVYLQNMELFVANVGDAQAVLVHSNGDFKFLTRNHDPAEAGERERIREAGGFVSRNGKLNDKLSVSRAFGYYPMVPAVIAAPSTRKVTLTTQDEMIILASGELWDYVAPDLVVDVARSERADLMRASQKLRDLAIAYGATNKIMVMIAGVSDLKRRGERPKLRTPSLSMGPSPLGDDHIFPPPSKYKKRGAPSDSRLARLDRVEAPTGELAIIFTDIKKSTSLWETYPVAMRSAIQIHNDLFRRQLAQIGGFEVKTEGDAFMVSFSTATAALLWCFTCQSQLLEAEWPTEILESAACRPQYDSDDNIIYRGLSVRMGVHWGTPVCEKDPVTGRMDYFGPMVNRASRISAVADGGQIFVSADFVAEIQRNLETFADYDRASSIDSSEGAYFDDYLSNSIRRELYQLSTQGFEVKDMGERKLKGLENPEFVYLMYPHSLAGRLNAPRESIDDPDTLPIALGRDKHLTIEASLVWRLWTVALRLEAFCSALENFGEVGIRQPEMSLLNAVRERPGEVTDSLVLNLIEHQVTRIETCANTLTIRHMIRPFNRANSLKDIAVPMAEILGELQVQLSEYKALKEQIDPSSLVSHQVPHAAVSVLKSAGQSSSAVSDMLAGGSSGSSTA

SEQ ID NO: 189 - protein, 1310 aa, Melampsora larici-populina 98AG31
IRISRSDGSFATLSCPLTYTTSEICHQLGRKLFNQKPPASYKLYIKERGLERVAAPNEKPLIFQRRRLEQAGYTMADRLDDVGRADYSYLIKFVYKEESLAAVGGDDDFQGNLEYVDLQARSIQAIPIFLFKHAPLLVSLNLSRNPKLDIPSDFIQLCTSLRELRLCYMGVKRVHPSIRQCHSLSRLDLSNNRIVDLEHARLDDLTDLMALKVHNNRLWNLPDYFKTFKSLRLLNLSNNKFESLPLIICEIESLVDLDISFNMITVLPFEIGQLKNLERFVILANPISTIPSTFVGLRQLREIDCRRCMLGDIAIFSELPKLKKLLCENNGVTILDGAFNSLTELNASHNSITRLLLVGTGSTLVSLNVSHAKISSLGQEFFDALVSCESLNMDNNQIKSFSDSFNQLTNLRNFSMKNNQLTSLPESIGQLQRLHTLDLANNNLSALPKTIWNCSQLIVLNASSNLIEEFPMPPLAESLTQEEMKRKASIPSMKTNNVATAAGTGSGGGGGSSGGIGHSNSSQSVSRSLPPLSKSLQELFLGDNGLGDNVFSPISLLSELRVLNLSFNDLYEVPSLTLSKCESLEELYLSGNSLTSLPGEDFENLIGLKTLFVNGNKLQTLPAELGKLKHLESLDVSSNVLKYNVTNWPYDWNWNWNLDLQYLNLSGNKRLEIKPAAGNQQDAIATAKRKNLSNFNALRRLRLLGLMDVTLTTPSVPDESEDRRVRVTQSEVSSMGYGIADSMGREDYNVVGLDMVVSRFRNKDDESLFGLFDAHSKTAFAGGKLAKYLHDGFSSILSSELRRLREGESVSEALRRAFLNINRDYGNLVVSQFEGRRKGSSGSLLTSERPSITGTNGYADGKCGASGVVVYVAKKTVYVANVGDALAVIAKRGGAAHPIAHKHDPFDSVEIERIRSAEGWVSQKGLVADEVEVSRSFGYFHVHPAINSKPSVQTIELSEDDELIIIANAGIWSHITYQAAVDVARAQNRKADPMMAAQKLRDLALSYGAESNLMVMVVALGDLFKAKRRLTYRGAGGAQIDEEAYGATRVAARRGQLTDAPGEKYLTLLDREVAPPTGMVALVFTDIRNSTSLWETNPGMQSAMRMHNQLLRRQLRAIGGYEVKTEGDAFMVSFPSVTSALLWCFTVQLELLREDWPQEILDSEDGKEIYDSNGLLCYRGLSVRMGIHWGNPHCEADPITRRMDYFGPMVNRSARISGEAKGGEITASLDVIEIVKTLCFDQESDEAQSLRNVKENKECAETVLDPATRRDVASIRKMGFGISEIGEKRLKGLEMPEFLSLIYPRALAGR

SEQ ID NO: 190 - protein, 2114 aa, Pyrenophora teres f. teres 0-1
MTKNESVGRHGSVESSWSSRSGDTIRPYGRAGSLRGTPVTVKTDKSLNSNAEKESEISPGTVPPAPPPKDASHRPRRPPNWDGPTTTSFGDHRKQLAVLETSGNRVPSISRNPPTASSANSHMAPWSTTNGGAMANSVWSSFFNDSNEDLAQSSPGFRPQSGSREDSMGFPLKDDRRPSVASATTVSSTGSKSSISRGFHKKLQNIFGDDFPADGRQHSDTSLPYAPDAQSQRPMRNRGNSLNNTIGSSHQSRPVSPTNSRPRTPQASSEVTPWEFQDSKEFPTPGENGGRRSSEQHSAKSGRSHHKLHVRLPGTTGHRHRSSKEENKAPDSRSDISQPYTLRPTTSRDDVPQNPRPNQPSALSSAFTSKTSLLGRPSSPTPSSFSDMPREDRIAQRSPSTSKPSHGFFARLRGKDKEKSDRVAPNDNLKSLSSVGTASTTSLNPSISTARSARVEPSPQAVAMAKRQPSTNGVDERLQAKARAPHHRLPTFRKDKRAPANEPTGRDPNDNIASTAGNDAVFFLDSNLDDMEGIVNLQQQPPMTPPVGELLKQPTVGEEIAAPGPEDDGTAAWDAPDSWAVKRMKDEMDKVRDVEDTGTPSKEESDSKTYCLRIFRVDSTFATLSATLNTTVQEIIQILGKKTVLQDELDNYHIVMRKHDTSRQLENNERPLLIQKRLLELAGYTDMDRLEDVGREDNSYLCRFTFLPAKMSGYSSLERDPGFSKMQKFSHIDLQGRNLITIPITLYQKATEIISLNLSRNLSLDVPRDFILACTNLREIKYTSNDARRLPPSLSLASRLTMLDISNNRLESLDRAELYKLQSLQGLRLSNNGLTRLPPYFGQYRALRSLNLSSNSLHEFPDFLCEVRTLVDLDISFNSISSLPRIGQLTCLERLWATNNKLTGSFPPTLSNLVNLREIDVRFNALDSMDVMSQLPRLEYLMIGHNSISAFEGYFPKIRVLHMNHNPVTRFGLTQPTPSLSVLNLASAKLAQLPEDLFGKLTGLTKLILDKNHFTSISNNIGKLYRLEHLSIARNSLDVLPAEIGRLVELKYLDVRENNLAVLPQELWYARRLETLNVSSNVLDAFPKPGTAPPQVANGEQAQVDGPTPGLTSSPSYEELGKLEDFQNRRPSQASGGLSVGTSPAPSNRKGSIASYNTTSTARKPSVASRAPTEGTVAPMSRKDSSLSSRLVTTFAGSLRHVFLADNRLTDDVFDELCLLPELRIVNLAYNLIYDVPPRTIRRWQHLTELYLSGNDLTSLPSEDLEEVGSLKVLHINNNKFQVLPAELGKVAQLAVLDVASNSLKYNVSNWPYDWNWNWNHKLRYLNLSGNKRLEIKPSGSYSGSGVNMREGRDLTDFSSLVNLRVLGLMDVTMMVPSVPEQSEDRRVRTAGSAVGTMAYGMADSLGRNEHISTMDMVVPRFRSHDDEQLLGLFDAQPLAGGGSKIAKYLYDHFKNRFADELERLRPQETPSDALRRTYLGLNKELATAANQGIDKNAFTAPTQPRSSVPELGDDDLTSGSVATVLFLKEMELYISNVGDAQALLIRSEGGHKILTRKHDPAEPSERSRIREAGGFVSRQGKLNDILEVSRAFGYVQMSPSVIASPHILNLTLGDTDEMVLVASRELWEYLTPDFAVDVARSERNDLMRAAQKLRDLAIAFGATNKIMVMLLGVSDLKSKQRARYRTQSMSLVPAPGADPDWGASRRRGKKGNLVGDSKLARLDNEVDAPTGEVSLVFTDIKNSTILWETYPIAMRSAIKMHNELMRRQLRIIGGYEVKTEGDAFMVAFRTVTSALLWCFTIQSQLLEVQWPQEILNSVNGQEVVDPDGNVIFRGLSVRMGIHWGTPVCEVDPVTKRMDYFGPMVNRASRISSVADGGQITVSSDFIAEIQRLLETHIEGDRNNSAGSEEAYGDDMNSQMIRGELRSLSSQGFEVKDLGERRLKGLENPEYIYLMYPHSLASRLAVQRQTEQKPAEQKTEAIVGQKMAGSQLTIDTEDVWDLWNISLRLEMLCSSLESPGCVELKPPETALLERMKSRGGEITDRFLINFVEHQISRIESCANTLALRHMIRPFGAAPLLQQACHMGDIFTELEAKLKRLEEFERGAMEGMAPS

SEQ ID NO: 191 - protein, 2019 aa, Puccinia graminis f. sp. tritici CRL 75-36-700-3
MLRRKASRGDINASEDLSFATRSFPEELNFPSSKIKDLTGATDQEWQAQQQQQQQPSAAPTASSTTSKKQRIRKLTGGSGLSSKEKTLKAEQNNQQNQISSLGSTSTLTQSNRLMPANQGEVITLDTNLDEMDGIINRDHAALQVRRTSSFSGAPSFLSSPSHPNNSDVQGTGGGTLFADPFNPGRTLGSPNCVHRNAGFQESGAGSISGPSDPSMHNYPSLPLSHRSNRSFGGASARDFNTGDTRRRGSQNSQQSLTANNLQTNMNDLDGGLSAPAVNRSLFPATPLGPNSPSRKPSAHQYSSSNQVGPNPTPTCITGLGIGAAMVSTANGSISGLGGGRCGSNTPSLNNPGGAGAAAGWTAPESWAVNPMDGNESGDTDADESEEEDGLIVSDFYPPHPDNHEGASDPNGGPPLTARNIPPYQSNGSFSGASGTTAYSLGSQTTGTSISGSLYSTTTIGSSGANTALMIPPINRLGSIDESVKSSGFGTPNLNGANANASRRPSEAGGMSIMDGSEGSGHGGRPAAGSNISGSILNGKLGSATRAGQIDGSKSWTIRISRADGSFATLSCPLMYTAAEICHQLGRKLFNQKPPAGYKLYMKERGLERVMAPNEKPLVFQRRRLEQAGYTILDRLDDVGRLDYSYLMKFLYKEESLTAAATDEDFHEHYEFVDLQARSIQAIPIVLFNHAALLISLNLSKNPKLDIPLDFIQLCTSLRELKLCHMAMKRVQPSIRQCHSLMRLDISNNRIVDLEHARLDDLTELMALKAHNNRLWTLPDYFRDFRSLSLLNISNNKFESLPGVICQIESLVDLDISFNMINSLPNEIGQLKNLERFVFLANPISTIPSTFSGLNQLRELDCRRCLLGDIAIFSELPYLKKLLCENNAATILDGRFNSLQELNAGHNSITRLLLVGTGQTLVSLNVSYAKISSLGQEFFDALVSCESLNLDSNQIKSFSDSFSQLTNLRNFSMKNNQLTSLPDSIGQLQRLHTLDLANNNLGSLPSTIWNCSQLIVLNVSSNLIQEFPMPQVASSNDPSNPNAEDGKPQLKGMPSLPTLKPSNGNSTTNNRSLPPLAKSLQELFMGDNGLGDNVFGPISLLSELRVLNLSFNELYEIPSSTLSKCESLEELYLSGNSLTSLPAEDFENLSNLKTFFLNGNKLQTLPAELGKLKHLESLDVSSNLLKYNVTNWPYDWNWNWNLDLQYLNLSGNKRLEIKPAAGGQQDAVAAAKRKNLSNFNALRRLRVLGLMDVTLTTPSVPDESEDRRVRVTQSEVSSMGYGIADSMGREDYNVVGLDMVVSRFRNRDDESLFGLFDAHSKTPFGGGKLAKFLHDSFSTTLAGELRRLKENESVTEALRRAFLNVNRDYGNMVTSQFDTRRKGSNVGLQRSERPSITAANCGVDAKCGASAVVMYVAKKTIYVANVGDALAVVAKRGGVALPLAHKHDPFDATEIERIRSAEAWVSQKGLVEDEVEVSRSFGYFHVHPAINARPSIQTLDVSEDDEFIIIANAGLWSHMTYQAAVDVARAQNRKADPMRAAQKLRDLALSYGAESNLMVMVIALGDLFKARRRYTYRGAGGAQIDDELYGATRVATRRGQMLDAPGEKYLTLLDREVAPPTGMVALVFTDIRNSTSLWETNPGMQSAMRMHNQLLRRQLRAIGGYEVKTEGDAFMVSFPSVTSALLWCFTVQLELLREDWPQEILDAEDGKEIYDSNGMLCYRGLSVRMGIHWGNPHCEADPITRRMDYFGPMVNRTARISGEAKGGEITASLDVIEIVKTLCFDHTDGKEGSDPLAHETDAIVDPATRRDVASIRKMGFGVSEIGEKRLKGLEMPEFISLIYPRSLAGRLNNQGASLGGPDSKVDEVYEPAPRMLDVNHIRQLAALVVRLEAVSAATVHAPLSFSPSSGGATNKLGGSAGEAGATSSGSSNTRPKSKLFNGHLLTYPIRLESTDEELAAILENQVIRIENVLSSLELRSLGPIYDVLLALGDAVKIQPNVLLHALESFGLASNAAGLF

SEQ ID NO: 192 - protein, 1785 aa, Serpula lacrymans var. lacrymans S7.3
MTLEIHHGSVTGEDFGRKEEEFESPHRHNNFPRIPEQLSSAAASLPVLQKEDLLPPHILVPHAPNDEENTVIAPWLDESSAAPGKRSFGLPQKASFSSFSLPRQGSTASLLSRTRNSESHSIAESYTSSIQSEATLVSSSPESRKGKSSMSIFNIIKKSRSRSRLASDSDRLGLLSRSHSPPNRPSQTFTDTFMTSLSIPEPPPPPPPPLPKKDKLVRPRRKAQNRPPPLPPKDGVYKLDTDIDHMEGIIKLTALPNQNMESTSSPGSGIESQQSSALSFSDASIHHASSSPTGSFFINPFLPSIVAKGKAHLVHDQRKVSPKTIFPMDGEAPEGDDRDDQEMDPVWIAPESWAVHKRREGNLGPEEASSEESLAVVGAKLPASNLSVNGGGTNKPKMRRKTNKTLMPPVHDGKTYRVRIYRADNTYHVATISLLSTVAELTPLLDMKLTDENAESHRLYLKERGRERLLLPTEKPAEIVRRRLEHAGYDQADSLDFLGGEDMTFLMKFIYKTHLLGPTAEDLTFDEFEYVDLTGRAIPAIPIVLHQNASSIIYLNLSRNPMVEIPLDFLQACTTLRELRLCNMAMKKVPSSVRHTASLHRLDLSCNRIMDLDDAGLDRIPELTNLKLQNNRIEKLASYFPGMRSLKYLNISNNMFSHFPSVICEMPSLVDLDVSFNTITELPDKIGLLKKLERLVILGNQVSKLPDECAALVSLRVLDCRRNGISDLSPVPYPLTSLDISHAKLSSFSDLDLSQLSSLQHLKIDNNSFRSIPDSLGELSRLITLCCSNNQLDALPSSIGQLQRLETLEAHNNSLKELPETLWNCASLTLINVTSNLLETWHDPPSVSVTPSVGVNLEAVSPSRPSYQERKMSSAASITSSTTSPLPSLAHSLERLYVGENRLTDEALPPLTILKELRVLNLSFNEIKQVPPSFLKNLVKLEELYLSGNNLTSIPIEDLHRLQNLTVLFLNGNQLQTLPRELVKIKNLSVIDVGSNLLKYNINNWEFDWNWNFNKNLKYLNLSGNKRLEIKPEKSKSQSENEEGDRVLLAGFTELTQLRVLGMMDVTTTFLPNIPDEGDDRRVRTSLSVVNGMSYGIADNIGKNGHLQMLDLVQPEFRERKNEAVFAMFGRFQAVTNNNRLSRFLHDKFIPIFSSQLSSLDRSKDEHVPDALRRTFLRLNKTLHDELYSNTSSRKMSQASVSTAGTVGYDVSYIRSGASGIVLYFVDKLLYVANVGQALAVISRQGSAELISTEHVPFNRSETARIRAAEGWISPKGLIHDETDTSRSFGFYHDFPVVNSRPDICVRPLTELDEFVIIGNRGLWDYVGYQTAVDIARSERGDPMIASQKLRDFAISYGADGSTMIMVISVADLFHSPDLLDPNSYTSLKRRGGKKADIADRQISRLDGEVSAPVGHLALAFTDIRNSTHLWEANAGMPTAMRLHNQLLRRQLRLCGGYVVKTEGDAFMCSFPTTLSALRWCLAVQVELLNQPWPSEILECDDGREFYDTQGNLVARGLSVRMGIHCGMPVCEPDPITNRMDYFGPMVNRSARITGSAAGGQIMCSADVVREINAKIFESGPDTEYSDVQPPQAIDAIRSMKIVVVPVGEVKLKGLEVPEMLSLVYPLELIGRQSPEKYTPHPMAMMQPILPPQPLGPPQPMVTSSKVHPKISHVRDLAILCLRLEALASCRVFRPREQNERLGEERLDSSVMQGDLRLLLPPLDEKTSDLEILMHLDSLSIRIENAIASLTLKRLACHSDSIVSALGRGGLDERTLQLLLSSLSC

SEQ ID NO: 193 - protein, 1828 aa, Serpula lacrymans var. lacrymans S7.9
MTLEIHHGSVTGEDFGRKEEEFESPHRHNNFPRIPEQLSSAAASLPVLQKEDLLPPHILVPHAPNDEENTVIAPWLDESSAAPGKRSFGLPQKASFSSFSLPRQGSTASLLSRTRNSESHSIAESYTSSIQSEATLVSSSPESRKGKSSMSIFNIIKKSRSRSRLASDSDRLGLLSRSHSPPNRPSQTFTDTFMTSLSIPEPPPPPPPPLPKKDKLVRPRRKAQNRPPPLPPKDGVYKLDTDIDHMEGIIKLTALPNQNMESTSSPGSGIESQQSSALSFSDASIHHASSSPTGSFFINPFLPSIVAKGKAHLVHDQRKVSPKTIFPMDGEAPEGDDRDDQEMDPVWIAPESWAVHKRREGNLGPEEASSEESLAVVGAKLPASNLSVNGGGTNKPKMRRKTNKTLMPPVHDGKTYRVRIYRADNTYHVATISLLSTVAELTPLLDMKLTDENAESHRLYLKERGREKPAEIVRRRLEHAGYDQADSLDFLGGEDMTFLMKFIYKTHLLGPTAEDLTFDEFEYVDLTGRAIPAIPIVLHQNASSIIYLNLSRNPMVEIPLDFLQACTTLRELRLCNMAMKKVPSSVRHTASLHRLDLSCNRIMDLDDAGLDRIPELTNLKLQNNRIEKLASYFPGMRSLKYLNISNNMFSHFPSVICEMPSLVDLDVSFNTITELPDKIGLLKKLERLVILGNQVSKLPDECAALVSLRVLDCRRNGISDLSPVCQLSRLDTLLADHNALHALDLSQLPLLTTLDVSHSDITRLTLLPNPACQVPYPLTSLDISHAKLSSFSDLDLSQLSSLQHLKIDNNSFRSIPDSLGELSRLITLCCSNNQLDALPSSIGQLQRLETLEAHNNSLKELPETLWNCASLTLINVTSNLLETWHDPPSVSVTPSVGVNLEAVSPSRPSYQERKMSSAASITSSTTSPLPSLAHSLERLYVGENRLTDEALPPLTILKELRVLNLSFNEIKQVPPSFLKNLVKLEELYLSGNNLTSIPIEDLHRLQNLTVLFLNGNQLQTLPRELVKIKNLSVIDVGSNLLKYNINNWEFDWNWNFNKNLKYLNLSGNKRLEIKPEKSKSQSENEEGDRVLLAGFTELTQLRVLGMMDVTTTFLPNIPDEGDDRRVRTSLSVVNGMSYGIADNIGKNGHLQMLDLVQPEFRERKNEAVFAMFGRFQAVTNNNRLSRFLHDKFIPIFSSQLSSLDRSKDEHVPDALRRTFLRLNKTLHDELYSNTSSRKMSQASVSTAGTVGYDVSYIRSGASGIVLYFVDKLLYVANVGQALAVISRQGSAELISTEHVPFNRSETARIRAAEGWISPKGLIHDETDTSRSFGFYHDFPVVNSRPDICVRPLTELDEFVIIGNRGLWDYVGYQTAVDIARSERGDPMIASQKLRDFAISYGADGSTMIMVISVADLFHSPDLLDPNSYTSLKRRGGKKADIADRQISRLDGEVSAPVGHLALAFTDIRNSTHLWEANAGMPTAMRLHNQLLRRQLRLCGGYVVKTEGDAFMCSFPTTLSALRWCLAVQVELLNQPWPSEILECDDGREFYDTQGNLVARGLSVRMGIHCGMPVCEPDPITNRMDYFGPMVNRSARITGSAAGGQIMCSADVVREINAKIFESGPDTEYSDVQPPQAIDAIRSMKIVVVPVGEVKLKGLEVPEMLSLVYPLELIGRQSPEKYTPHPMAMMQPILPPQPLGPPQPMVTSSKVHPKISHVRDLAILCLRLEALASCRVFRPREQNERLGEERLDSSVMQGDLRLLLPPLDEKTSDLEILMHLDSLSIRIENAIASLTLKRLACHSDSIVSALGRGGLDERTLQLLLSSLSC

SEQ ID NO: 194 - protein, 1889 aa, Mycosphaerella graminicola IPO323
MGFPGDGEDRRPSIASLTTVSSAGSKSSAGGGRVHKKLQGFFGDDVTLPGVINDASRQNSEASSIRNGASSALASGGQPGIRNNSFNDAMMRSGPPSPSLSRPRTPNPQPVSEVTPWVVQDPENAPDSFFPSGTSNGKSSKNSTASRLHLPGHRHNRSNDERQSGGFPLRPATSREQSFSGMRKEPTPTSRSAALNLKQTRSISPAPSERPETIVVGSCYPSTQTTGTKAVSKPMTKSKTDLASMGATPRKEHRLPFKSKKTDTFPTEANRPVKDPNESHAVVGEALWHLDTDMSHMEGIVDHKQPLMTPPTGEIYAGWPPEQEPVESTTEEKGAWDAPDSWAVNKVADENLRRLTELDDDGNVPTDDSGPMYFMRIFRADSTFAVISASLNTTAAELISMMAKKTFLQDELDKYQIIMRKQDTSRQLAPGERPLVIQKRLLEMAGYQEQDHLEDLGREDHGYLCRFTFLPSKMSGYSSLERDPGFNKMQRFNHIDLSGRNLITIPITLYQKATEIITLNLSRNLTLDIPKDFIQSCSQLREIKYTSNEAWRVPPSLSLATRLTTLDISNNRLEQLEHADLHKLQGLLSLKLSNNKLANVPPYFQQYRALRSLNLSSNSLTEFPDALRKLTTLVDLDISFNSISNMGDVSTLVNLERLWATNNKLSGPFHKSFSSLVSLREIDARFNAISNIDVVSQLPKLEALMLGHNSISQFEGSFHCLKVLFLNHNPVTNFDLNSPVPSLSVLNLASAKLAQLPDALFMKMSGLTKLTISKNHFVSLSPNFGLLQKLEYLSIAKNELSRIPPEIGRLTELRYLDVRENNLGMLPPEIWYAKRLETLNVSSNVLQDFPKPGSPLPPLPDAPVTLTPNTLVPNSGGSPDFEELGKLEDFQLRRPSQVAGMMSTSSSPGSNSRKGSVVSYHSGKSNALARGSTASSVGTVTPGGPARKDSTLSSRLAATFSSSLRHLFLADNRLEDDVFNELVLLPELRILNLSYNRLYDVPTRTIRKWTHLTELYLSGNDLTSIPSEDLEEGSSLKVLHINNNKFQVLPAELGKVQRLAILDVGSNMLKYNVSNWPYDWNWNWNRQLRYLNLSGNKRLEIKPASQATTERGQRDLTDFSSLINLRILGLMDVTLTIPSVPDQAPDRRVRLAGSVIGTTMPYGMADTLGRNEHLSTLDMVVPRFRGHEDEALIGLFDGQSLSSGGSKIAKFLHEKFKHYFIEELEKTKPEENPIDALRRTYLALNKELATAATQAIDAKEHPSSALVHRGSVVGPELGEDDLTSGSTATVMYLHGMELYMSNVGDAQALLIQSEGGHRQITRKHDPAEASERQRIREAGGFVSRQGKLNDQLDVSRAFGYVQLTPCVIAEPYVSKVDIKESDEMILLASRELWDYLTPDFAVDVARSERADLMRAAQKLRDLAIAFGATGKIMVMMIGVSDLRKREKARFRTHSMSMGPSGSPDDYFTTVRKAKRGRDAVGDSKLARLDQEVDAPTGEVTLVFTDIKNSTILWETYPIAMQSAIKMHNEVMRRHLRIIGGYEVKTEGDAFMVAFPTVTSALLWCFTIQSQLLEVQWPQEILNSVHGEEMRDGDGNPIFRGLSVRMGIHWGRPVCEIDPVTKRMDYFGPMVNRAARIESVADGGQICVSSDFIQEVQRMLESHIESDRSTSTGSEDTLNDDIMSQTIRRELRSLSSQGFEVKDLGQRTLKGLENPEYIYLMYPHSLASRLVVQQQKAEAESRAHIASEKEAKKTRNSQLTIDTDNVWDLWNVSLRLEMLCSTLESPGVKSLRAPETALLERMKHGQGAGEITDRFLVNFVEHQISRIETCISTLAIRNMIRPFAKGMLSQACPMEDILGDLTAQLSELKTLKAATAADYDDFEAFVKPRK

SEQ ID NO: 195 - protein, 2037 aa, Trichoderma reesei QM6a
MTPSSSSQGGRRLSDLTNYRRDLAVLDPPRGHPNPNYPPSLVDESADNMSIFSQFSPGLHGMGSRTGASSSLGLQDSPEQLYYTDGRRPSAASVTTTASSTGSKASGPRGGFRKLQGFFGEEFPGRDSSESSLPNSYMGKDQRSRSYSHTRPTHRDRNYSNATDHTRDASPASSRPRTPVPAPEVVPFLYQDNNDIARYGEAPVRDIMTGPDRERYMSDGAPQVPPKSSSSSRPGIVHLPGHHHRHNKSIDDPRSLRPTTSREDSTSSSYPRDRGGMAGTLFSSSRSRAQSPTPSVGSGHAPYSRSGQAEGHASPGHHGKLGFIGRLRRQHKDKDDGAGGGSKLKDLPQSTRSLQAKSSKTDLTRPELSPSAFPSSFVLPSGDVSDASETRSLTAPRATFKNTFPFSKKQRPARLNDADETIGPTDRAETGHIHHLDTNLNDMEGILAKPPPLTPMDTSFVNNIDPDPIDSAVSPPKGGSWDAPDSWAVRRGTEDTTIQQPEVEELSSPPRPEEKLTPYFIRIFRSDGTFSTHSMALDATVAEVISQVIKKTYVVDGLENYHIIMKKHDLIRVLTPGERPLLIQKRLLQQVGYEEKDRIEELGREDNGYLCRFMFLSARESDFHSKTADLGIKATQKVNYVDLSGRNLVTIPISLYLKANDIISLNLSRNLSLDVPRDFIQSCKNLRDIKFNNNEARKLPLSLGRAARLTYLDASNNRLEQLDNAELNALTGLLRMNLANNRLTHLPPYFGAYQALRSLNISSNFLESFPPFLCDLHSLVDLDLSFNSIAELPEEIGQLKSLEKLLITNNHLSGGVPRTFRDLISLRELDIKYNYITNIDVISELPKLEILYAAHNHISAFVGKFERIRQLKLNSNPLNKFEITEPIPTLKTLNLSQGQLASIDSAFSNMPNLERLILDKNHFVSLPPQIGALGRLEHFSIAHNSVGELPPQIGCLTELRVLDVRDNNISKLPMEIWWANKLETFNASSNMLEAFPKAASRAPRLPGEELQGPPSTNGKSAPLGTLSTSGSSEELEEERRPSQASSTTLLSVGPSPNIPGADRKSSVVSVYGKGGRKTSVMSKSTSQSHNTVSTSNQSLRKDSGLSSRLTNTFAGSLRNLYLADNRLDDDVFDQITLLAELRVLNLSYNWEISDMPQRSMKSWPQLVELYLSGNVLTSLPADDLEESSLLQTLYINGNKFTNLPADISRAKKLAVLDCGNNSLKYNIANVPYDWNWNLNPNLRYLNLSGNKRLEIKQTAWGGIDGPGAVNREEYTDFSRLTNLRILGLMDVTLTQPSIPDQSEDRRVRTSGSLAGHLPYGMADTLGKNEHLSTVDLVVPRFNSSETEMLLGLFDGQALSNSGSKIAKYLHENFGHIFAQELKALKTRQNETPVDALRRAFLALNKELVTVAVQYSEDRKKKSHRVATVLYLQGTELYVANVGDVQAMVIKTDSKHHILTRKHDPAEPSERSRIREAGGWVSRNGRLNDVLQVSRAFGYVDMMPAVMAAPHVTNMTIRENDDIIVMATSELWEYLPPGLVTDIARAERQDLMRAAQKLRDIAMAYGASGKIMVMMISVVDLKRRVERSRLHRGTSMSLYPSGVPAEAPYLLSTRRGRKGKADVLDSSLNRLEAEIPAPTGNVSIVFTDIKNSTTLWEMYPNAMRSAIKLHNEVMRRQLRRIGGYEVKTEGDAFMVSFPTATSALLWCFAVQMELLEVPWPSEVLNSMSCQPIHDKENALIFKGLSVRMGIHYGDCVSETDPVTRRMDYFGPMVNKASRISACADGGQITVSSDFISEIQRCLENFQDTDRNVSTGSEASFDDVSLATAIRKDLRSLTSQGFEVKEMGEKKLKGLENPEVVYSLYPHALTGRIEYHLQHERQDLLADKPTSVMPGGELPFDPDMIWSLWRVSLRLEMLCSTLEEVRGPGLQPPETELLERMKTRGGEVTERFLINFMEHQVSRIETCVSTLTMRHLAIGGGALRELNQLRAPMAAVFDYFLKQKEELERYKQKYGELSDAEPSNGATENGDGSDTEQEK

SEQ ID NO: 196 - protein, 2211 aa, Chaetomium thermophilum var. thermophilum DSM 1495
MPRPDDSARRSSMTGSSTDSAISSITAKPLPSLPPESNAVPSATAAASVGLGVSSSHSSSNALHRLATHGSRRGAPSRLKTDEDSGYPGRRSVKESEGQVSPTSNGSRPFGLPTSSTNSSMREHIMSDLFEHRRDLAILEGPSASRAARGQHTSPSSGSLAQQNAPSAMSSSSWIAGDANSSAPGLSPNDPVTTTFYNDSTDNLSLSSQVSPNVPATSSSRPPPSSRTPATFVDSPEFAYLTDDRRPSVVSIATTASSQGSRTSGARGGLRKLQGFFGEEFPGRDSSEFSLPFPTAGKEHRSHSYSYSRPHRDRNYSNATDHGRDASPSGSRPRTPVPAPEVVPFLYQEVEDIAKYGEAPVREVLTGPDRERFISDSGSQNPPKTSGSGRSGHSIVHLGGHSHRHNKSNDDPRALRPSISREDSISSIPKERSGSSIMHGSRSRAQSPAPSANGSYWGSRSTGGDGQTSPGHQSKRSRFLPRFRKHHKEKYDLADLKKFSASSNSLGSRPSRQDSAAASIEGSEWPVSPDPREFFGPRPSYGRGATFNNKFPFSKKSRSSRQHDDDENIGPTDKQEVGTVFHLDTNLNDMEGIVSRPLPLTPMDSDLINDLDFDKLPIKSDPSGAWFAPDSWGVRPRDNSTQAPEVDDITVLPRPEEKLTNYCIRVFRADDTFVTLQMALDATVHDLISTIVRKTYRIDGIENYHIVMKRRNLIRVLNNAERPLLIQKRLLQQVGYEERDRIEDIGRDDNSYICRFMFLSIRESDFHYGTYDVGLNRMQQKLIHVDLSGRNLVTIPVPLYGKAPDIISLNLSRNLSLDVPRDFIQACSGLKDIKYTNNEARRLPPSFSCAQKLTYLDVSNNRLDQLDHAELGDLRGLLKLNLANNRLKSLPTYFANYTLLRTLTVSSNFLEKFPSFLCDLENLVDLDLSFNLISTLPDNIGNLRSLEKFVITNNRLTGSFPESFKNLGSLRELNFKYNAITNIDVVAQLPKLEILTADHNSISQFVGTFSRLRSLKLNSNPITKFELREPVPTLKVLNLSNCQLASIDESFNNMLNLERLILDRNYFVSLPNQIGNLRRLDHFSIAHNTIGELPPEIGCLTELRVLDVHGNNIRKLPTELWWANKLETLNASSNLLENFPKPASRAPQPPGDPSSTPNSLYSKKSVAGRGLSPMPSSEELRGGDASRRPSQASSTLLSVGPSPVPGAGDRKGSMVSLYGKGGRKTSVVSRSTQSSVSTSMGGPSYRKDSNLSTLITHTFAGSLRYLYLADNHIDDDVFEQLVHLQELRVLNLSYNSLTDMPQRSIKSWSQLTELYLSGNDLTTLPADDLEEYSMLQTLHINDNKFTNLPADIQRAKKLAVLDCGSNSLKYNIANVPYDWNWNLNPNLRYLNLSGNRRLEIKPTYPSGASQGREKYEDFNRLVHLRVLGLMDVTVLDPSVPDENEDRRIRTSDSMAGYLPYGMADTLGKNKHLSTVDLVVPRFNSNDAELLMALFDGQALSSGGSKIAKFLHENFGRIFSRELRDLRAAQGETPEDALRRAFLALNKELINAATSTQNRSSYSVVLSKEDLNSGSVATVVYLNEQELYVANVGDVQAMLIHTDSQFKMLTKKHDPADPHERSRIRDAGGWVSRNGRLNDTLEVSRAFGYSEMMPAVQAAPHVKHHSITEQDEAILVATREVWEYLTPELVVDVYRSVRGDLMRASQKIRDLAMAYGATNKIMVMMLSVADLKRRRERSRMHRGQSMSWFNFPPDDSMALSTRRGKKAKVDGPLDSTLQRLDAEVPAPTGMIAIVFTDIKNSTQLWEMYPEAMRSAIKLHNDTMRRQLRRIGGFEVKTEGDAFMVSFQTATAALLWCFAVQIHLLSLNWPAEMLNSVICAPIFDRNNNLIFRGLSVRMGIHWGEPLAEPDPVTRRMDYFGPMVNKASRISACADGGQITVSSDFIMEIQRCLETYQEGMEIDDENDPFAKSIRQNLRELSSQGFEVKDMGEMKLKGLENPEYIYSLYPHALAGRIDMHNLNQKQRQEAEQKPARLSPDSQLSFDPENVWGLWRIALRLEMLCSSLEDMSGRGLQPPETELMERMRQRGGEVTERFLLNFLEHQVSRIETCVATLAIRHIILSSDRLRQLNDLRAPMASVLDTLQAKLALLERYEARYGPLPPDDAANDQYMTSDSPLPSPGPPQLPPLPLASPRFTEFESVLNGNGGVVSEEK

SEQ ID NO: 197 - protein, 2009 aa, Rhodotorula glutinis ATCC 204091
MADYSQAPLVPRSSKQAKMLGVGADIDQRPPGSAGSNLSDWNGWGVQDQAARGRQGSPADVAPPWGNGAEPKRKGTLLPSSSSQPLRGTRSASVLRGHAEKEPPVKEKKRGLFGGLLKRRGSKSDVRDQHSDSGSVSDFGLPPPAQFDSSTLPAKLQARGDAYDLSSSLPSRNGKSSKKSRRPTTPIGAFVTGSSRNTPTPRQQAVFTNDPEIALDTNLDSMEGIISSAPSTSAGVRPTSSHERGFGGSVSSGTSGNGLTRSGSGSHASYASNGRRPSLAPSYSDAGPRGAHHGQASAVAFWNYGGGATAAEQKSAAKAATLMGTAPPAVPGVPGGAPVRPGLGSRTSSQLSLTGGSATPTQAGMSSSGSTAKGLPPVPRGSAAARTAAVVGGAAGSAGAWTAPDSWAVKAEAGASLDHDSSEDDVDEDEMEVMDETEESEPGASPRIGTAQTVREGMPDGLAAVKLFGSMETEVLKNGRPATGGSRPLMRSGRPGTADGEARKASQKPFMVRIYRVDNTFSTLPVPLGATASEMTAMLARKFQVNAKTTYALYLREKGLERRVGPNEKPVLLQRRKFEQAGYTELDKLEELGREDNSYLSKLVYKAQYSTMQGVAEESFAGESMEFVDLSGKGVETIPIFLYKHSHEIRSLNLSRNRPFDLPTDFIQGCTALRELVLSNMGIKRLPQAIKECQHLTRLDISNNNIVDLEHIALDTLGNLSSIKCHNNRLSTVPEYFRNFRQLKYLNLSNNRFDKIPLVVCEIEPLLELDFSFNTVTVVPPEIGQLENLERLNLLANILTSLPSTLGSLISLKELDIRRNVISDFSPLTSIPVLEVLRCEHNQASTLDASWANIRILTAKHNSLTRFALTGTSTTLTSLNLSYGKLSTLSPEIFGHLGSVETLILDNNTLRILPDGIGSLPNLVTFSIKNNLLTSLPDSIGRLQRLQSLQVSGNDLQTLPSALWLCSQLSTLNASSNLIKDFPDPPLPTVAPAATPTSSLGDGGDELDLRQLAAAVKPPTTSSGRLAPPLSMSLQRLFLGDNQLGDDVFAPISLMAELRVLNLSFNDIYEIPTSSLFKCQSLEELYLSGNKLTSLPPDDLERLVNLKLLYLNGNKLQTLPAELGKIKKLFALDVGSNVLKYNIANWPYDWNWNWNLELRYLNLSGNKRLEIKPGHQNDTSNLPRSAKRRNLADFSALTKLHVLGLMDVTLMIPSVPDENEDRRVRTSLSEINDMGYGIADTLGSRFDTLSLVDIVIPRFRSKDDEAIFGLFDAVNKGQNTGARLVKYLQDAFSAVLTLELSRLKSGEVTSDALRRAFLNINRDYGNLLLPALESRRKGSEISLTDKTMSSVRTGAAGIIVYIRRKRLYVANAGNALAVIAGRGGTARLIAKRHEPFDSGEIARIRTAEGWISHRGYVNDEVDIARSFGFYNVFPAINAAPDVDEIELTETDEFVIIANRGLWEHMSYQTAVDVARTERSDPMAAAAKLRDLAISYGSSSNVMVMVLAVGDLFKAKKSGYYAKHRAAHGEDEGFYGAHKAGVVAGRRGKGEEGAGERYLNLLDREVPPPVGMVALVFTDIRNSTALWESNPGMQTAIRMHNQLLRRQLRAIGGYEVKTEGDAFMVSFPTVTSALLWCLTVQLELLREDWPQEILDSEEGKEILDSRGEILYRGLSVRMGIHWGAPVCEADPITRRMDYFGPIVNRAARISAVAEGGQISASQDVIDIIQDVVMQQKPGPSSLDSDDGEEEEDPEEYLDPRDKQDIAALRRLGFGITELGERKLKGLESAELISLIWPRVLKERIVPASADQDGSAAAAEIAKKTEVVQDETPQLLDVNTIKALGKVVQRLESVCGALVHGVENGLATPPHVPNSSARPSTPAQQAVAAKRKTLIHPTSFAFPVRADATDDELCALLESYLVRIENCLSTLTLHQLGPFTEVLSALGQALRVDQRSVLLALTRFAGLQQQQAMLLQAQASKPPSPAPDRPLSSGTVSRAGQPPAAPSFRQA

SEQ ID NO: 198 - protein, 2026 aa, Fusarium oxysporum Fo5176
MPTSFFNDSSDNLSLASQLSPGHQISNRQPHQHQYPSHPSQHDAPEASYFDGRRPSAASILTASSQGSKTSITRGGFRKLQGFFGEEFPGRDSSDGSLPTSLAGKDQRGRSYSHSRPTHRDRNYSNATDHTRDASPSSSRPRTPVPAPEVVPFLYQDNSDIARYGEAPVRDIMTGPDRERYVGDGSSQIPPKTSSSSRSGHSIVHLPGHHRHHKSNDDPRTLRPTMSRDDTAIGTQMSRDRGGSSAVYSTKSRGQSPTPSTRSAGMTWSTKSSQVDGQTSPGHHHGKRGIFGRLRRHHKDKDDIAKLRDLPQSTRSLQPKTSKPDLHRPSDVSTTTLPFSGTFVPGEMSDVPDMRPVPGQRGATFNNKFPFAKKGRTHRPHDYVDDAIGPTDRNDPNNIYHLDTNLNDMEGILTKPPPLTPMDTSFVNNVEPERHDSIISTAPKGRWDAPDSWAVRRNTEDNSYHGPEPDEIGSPPRPEEKASPYCIRIFRSDGTFSTHSMPLDSNVTDVISQVIKKTYVVDGLENYHIIMKKHDLIRVLTPPERPLLMQKRLLQQVGYEEKDRIEDLGREDNSYLCRFMFLSARESDFHAKTTDMGLARAQKLNYVDLSGRNLVTIPISLYSKAMEIISLNLSRNLSLDVPRDFIQSCKHLRDIKFNNNEARKLPPSLSRANRLTFLDVANNRLEQLEHAELNSLTGMLKMNLANNRLKHLPSYFGAYQSLRSLNISSNFLDKFPTFLCNLPSLVDLDLSFNAIATIPHEIGGLKNLEKLLITNNRLTHAVPASFGQLVSLRELDIKYNGISSIDIISELPKLEILSADHNCVSAFVGQFESLRQLKLNSNPLNKFEIVAPVPTLKILNLSNAQLASIDSSFVNMVNLEHLILDKNYFVSLPQEIGTLSRLEHFSIANNSVGELPAQIGCLTELRVLNVRGNNISKLPMELWWANRLETFNASSNVLEHFPKPASRAPRIPGEESQPAPPPVNGRAAPLGTLSATASSEELSDDRRPSQNSSTLLSVGPSPLNAGDRKSSVVSVYGKGGRKTSVVSRSATPSAPTQTVNTRKDSGMSSRLNNTFAGSLRNLHLADNRLDDDVFDQITLLAELRVLNLSYNDEISDMPQRSIKNWPQLVELYLSGNALTTLPADDLEESSLLQALYINGNRFTNLPADISRAKNLAVLDCGSNYLKYNISNVPYDWNWNLNPNLRYLNLSGNKRLEIKQTNTGPLGPGAVNREEYTDFSRLLNLRILGLMDVTLTQPSIPDQSEDRRVRTSGSLAGHLPYGMADTLGKHEHLSTVDLVVPRFNSSETEMLLGLFDGQALSSGGSKIAKYLHENFGHIFAGELKQLKTRSNETPVDALRRSFLQLNKDLVTIAIQQSEERPLKTHRGSGQPVILTKEDLNSGGVATVVYLQSTELYVANVGDAQAMVIQTDGTHKMLTRKHDPAEPNERSRIREAGGWVSRNGRLNDLLQVSRAFGYVDLMPAVQAAPYVSNMTIREQDDIILIATGELWEYLSPGLVTDIARAERQDLMRAAQKLRDLAIAYGASGKIMVMMISVADLKRRVERSRLHRGASMSLYPSGIPDDAQVLNTRRGRRTKGDVLDSSLNRLEAEIPAPTGNVSIVFTDIKNSTTLWEMYPSAMRSAIKLHNEVMRRQLRRIGGYEVKTEGDAFMVSFPTATSALLWTFAVQMQLLDVNWPSEVLNSVSCQPVYDKDNSLIFKGLSVRMGIHFGDCVSETDPVTRRMDYFGPMVNKAARISAVADGGQITVSTDFISEIQRCLENYQDTDRGNASGSEDTFDDETYASAIRKDLRSLTSQGFEVKEMGEKKLKGLENPEVVYSLYPHALAGRIEFHLQHERKEEGGGGGGDKPAVLAPGAELSIDPDAIWTLWRISLRLEMLCSSLEGNEAPGLQPPETELLERIKQRGGEVTDRFLLNFLEHQVSRIETCISTLAMRHLATGGGPIKELEDLQGPMTAILDMFMAQRKELERYRRKYGALPSSSSSEDEDDDDDDDDPDTEEGSDTEQEL

SEQ ID NO: 199 - protein, 2497 aa, Sporisorium reilianum SRZ2
MFSTMQSALRPVASSPEQRQQQQQQQQHAAPYEQPDFGLERHNSHDSNGSSNFTHRAHPPLSLDPSRSSYSFHSSQPDIASTPSPSSSRLAATNYSRPRLEHAQTQPSTPHHSHSGPRSYFSVEPHSHSFSGPSGHGISSSFDEDELRQIMSRSPGADLEACPDGDVAKGVKSANHQDISPFLFQNESAAPSSSRSSRANVNAPASASASPATGSLPLARTSNATTTHHSLADTSFGSIDNSGLVSSRSQHSLRPHTPPSATTSSSTLNGSRDTHASAAKKSRNPFGFLKKKPSTHSNASSTNPVRHEASMSSLSSRYGSNAANLNPMRPPAWLDHNRPLATTTSPSSASLRSHYHNPSTSASASWQNPLHARIDALPTAVSLEDELDNENQPKKDARKRIKGVRHHLGKNAHASKLGGDDADTARDPAFAAQSHSIEQEVELSLDMNFDQLEDFVDTNAARQRLQGSVTESTSPSDHRSPNGSEAGLHRSPSPSQNSLVDRHTSVASTLDSPSEASAAASSSLRQPSRTNTTMSTSTSTSTILSDRRPSQINLLPRNSVPRLSMAEMQNYQSLRKLSSNLIDLPQPSSLPLRRESIAATHASPESSQLGVASSADAILPDYRKDSVVSAHSMRSNHSGISPKTSYANLPSAIQEHPKGSAGATTPSGAGWASEASKDKPANGRADHAYQFPPAPDHNGTSLLSVRKSSASSGQEPSSSWMAPDSWAVQPDKMRDYLRDDNVGEEEDDDQDRAMAALASEGKRRGSSSGMSSTHASSMFRTSSTDPFKKTTSLAGSRRATDESVDPLTVLPPLPGSKPIDDASANKVDVLQQTNNLAQSALAQQQSQNQQAQTHQLVSTHIRPSSRGGAGAHMLASAGASAAAAAAGKLGLHRPSKHRTTTRPNTAGSIGATRPSTTTLSSTLSAEDDSSVNGSIRRDPHPLKRSTTANTGAPPGNALRNHFIRVYKQDSTFATLSCSLVSTANEVQTTLARKSLTAESAAYRLFVRDKGSERPLGISDKPAQLQRRRLLQAGYTENDGLEDIGRDDLSYLLRFVFRPDSVPTFDSESIGHSEHTFQRLDLQSRNLEMVPIFLYKHADWIVSLDLSGNPMSDLPLDFVQLCSSLRTLRLSNLALKRIPQSVRHSETLTHLDVSNNRIVELSHISLDLIPELMSLKVQNNRLFDLPPYFSGIRTLRNLNISNNRFDEFPSVICDVPSLVDLDVSFNSITELPAEIANLVNLERFILAANSLEKLPDSMSELVNLRTIDLRRNKVQDVSSLLGLPRLQNIQAESNNIKSFEATLGPQLTQVELGRNPLSKVRIAALTTCDLTSLDLSSTNMTRLEEGLFPQLPALVKLTLDGNQLVVLPDTLGELKRLEMLSCSNNLLATLPESIGDLKALKELLVHNNNLKTLPQSLWFCESLAHINLSSNLLESFPAAPDVRPDASTGDVAATAIGTSAILAARKGSTSSSLTHRSNTGGANGGTNISTPSELFVAPLSFSLQKLRLGDNRLGDEVFSVLSELTSLEVLNLSFNEIFEIPDFSLQTLTKLRELYISGNQLSTIPSDDLVVLQELRILHLNCNKLTTLPVELGKLKKLANLDVGNNVLKYNIANWHYDWNWNMNPELRYLNLSGNTRLEIKTKLSDMGFTRKSNISDFSRLTSLRMLGLMDVTMPLHSNATPDESDNRRVRTSLSQINGMAYGIADALGKHDNLSVIDLVIPTFRKDEGECIFGLFDGRGHGAHVGSRIAHHLAEWSGHRLSWEFQKHQNEKASEPVSVPDALRRAFLRLQKDYADALINDGNRKLSEAHAEAAADVTRSSAPAIAAASNKHDWRAGASAILAYMVERTLYIANAGDALAVMSRNGGTAHLISSKHEPFDRAEIERIRSAEGWVSLRGYVNDMLDVSRSFGYYHLFPIVNAAPAVTTVQLTDSDEFVIIANRTLWQYVSYQTAVDIARTQRNDPMIAAQKLRDFAISYGAEESIMVMVISVGDLFYRSGQRNGGGLTFSNYQNSDAIKKAGRRFREELPSDRTLARLDREVAPPIGQVALVFTDIKNSTSLWETNNGMQTAMRLHNYLLRRQLRTIGGYEVKTEGDAFMVSFPSVSAALLWCFTVQQQLLQEDWPREILDSEDGKEVYDPSGELIHRGLSVRMGIHWGRPVCEADPITRRMDYFGPMVNRAARISGAADGGQILASKDVIKELQGLLGTFDESSAAAGSGEGQELEKTEEELDEDAFRLLNPNVSRDVVLLRRMGFGLSQLGERRLKGLETPEMLWLVYPKQLAGRLEQAKTDDAPDAPTAQVYEPTVQLLDIEDVKQVGMLCLRLEYLSNSSVCPGIFAAKDEAERSNPSTPLDEVARNPMDGGGDVDKQVSLVSSSNSNVVPLLSLQARRKGVEAMLSMHPELLIYSIRDDATDEELAGILDQLTTRIQNAVSSLALNVLREKTANGSKDLGADPSVLDLLASLLSQPPPRASTTTAVALPSPLTSPRGRLMDLHP

SEQ ID NO: 200 - protein, 1712 aa, Candida tenuis ATCC 10573
MSQPFSFNSNFDSFKDKSKDSGSYPNTTTSSVNNHDYDSSNHDSNYSPRSSVVYLPGIQDEEHSSPPESPHRGTDQEGVDSNYKGFHNNRKSGNIIPPLQQPIKPRFRKKGSSLLGKLIYSTQRTSDSRNPSVSSSNTSANANTNANPNTRKSVSSTNSSGSGGKFKFRLSSITFDHNTPTSTLRAQRGSTTSFSKTRNSSGDSNSSGKHNTGFDIDINLSDLNGVLKTPPASGEGTDYLKPVHSTTAISPLRSWKAPDSWDVRAFTFDSPKEINEENSDSDSDSNSNSITISPTTAKTQLPVLYGSKNTLHVVPTSGKAKSNNSIIRVFREDNTFATILNSLDTTTTELLMSVQKKFFLDSTQNYRLSVHIGNYVKILEPFELPLKIQMGLLLLSGYTEADNLRMIGSEDLSYVCKFVVDVVYLRNLTHEEEVSLSKDYVNVDISGLDLKTIPIIFHQHTYEIESLNVADNPGIHIPLDFLQSCGYLSSLTFSRNGCSDFPVNIFEAKSLKYLDLEKNFLDEIPPKISHLRALKHLKLNSNQLNSLPKSFSKLENLETLNLSSNYFNSYPTPVSDLVNLRDLDLSYNDLSYLPKSLSNLKKLVKLNLCTNKLSKELPAFFGELSSLKRLDIRYNYISNIDVLGSLPNLEAVYASKNNISRFSDKMESFRLLNFDRNPITSLKFNNVLSRLTVLDLSKAKLTMIPPDFFNKISNIEKLVLDKNHLVELPDNLGNLLKLSYFSAFGNNIQSLPATIGNLHSLQYVDLHSNNLQTLPDEIWNLKVLTALNVSSNLLSSFPKPPLSLAKRISSSIVAQASSLIDSLVVLALADNRLNDDCFNSLSFLTQLKSLNLSYNDILEIPDGALRRMSKLTDLYLSGNELSALPGDDFEGIKSLRLLFLNHNKLVSLPAELSKLKNLQSLDVGSNQLKYNISNWPYDWSWHWNDKLKYLNFSGNKRFEIKQSHVKNPETGEYFDSLLVLKNLKVLGLIDVTLTTTAVPDQNTEMRVRTTASELDNVGYGVSDIMGARDYVSSRDLFIQKYRGNENEALFASFDGKGGPTSHGHRISSICKSLIGRHLSEELDKIKSDEEIPDAMRRTFLLLNKEINGILAAKKSGNSLATAQVRKDLADLTLAEDGSAGCSVTVIYIKDKKLYTANIGDTEALLSRDNGDHVMLTTKHDPTNRTEFERIRASGGYVSGDGTLDGDLYISRGAGFFSYLPHLHSGPDIKQLEIANGDDMIVLATKVFWDYISYELAVDIIRSEKEDPMLAAQKLRDFALSYGATDKMAVMVISLGDQKHLKQKYGSNGLYNNLGRENELFSNKKRRDRAQGPGDAALRMLDDEIEPPVGELAMVFTDIKNSTLLWDTYPVAMRSAIKIHNSIMRRQLRIIGGYEVKTEGDAFIVSFPSPTSALLWCFNVQQQLLTADWPVEILETDQCFEVTDNSGNIIYRGLSVRMGIHWGSPVCELDVVTRRMDYFGPIVNRTSRISALADGGQICISSDFLDEINTLFDLHKNIVDKKITINEGYQGNMVAGEIIEKEIKQLYEIGFVYYDIGERKLKGLEAPEHITLVYPKKLQIRFESFQKQTSAVADTSRLFGAIPIESIYGLRTISLRLERIILGLNGTHFMNEFQENSSNQLFDKSSSLFGDNEMLGLLNHVVVRIENCVGILHTRQQLSALDGSFNFKKSATANSVMSELSQIISEFKQLTGK

SEQ ID NO: 201 - protein, 1732 aa, Spathaspora passalidarum NRRL Y-27907
MSFLKRDKSKSNLKLQPLTASTSHKNNKQPPPADTGDHGHTPRHDYDCSPKSSVVSLPGLHHESIHTPTNLKENYSGFHANKRPKGIANVPPLAHPIKPRFKKKGSSLLNKLIYSRRDGDGEEQDQPGRATSLDSSMAGSTGSTHQRKSASSASSQTSKHKFRLPSLTLDHHHKQHQGSITSKSIDAETKLLPTEFDLNLDEMHGIIKSPEEVSLQLQQPIPPISLAASTASGAALGASAAAASAFASASGSAAAKTTPGWQAPDSWGVRIETKVDPNAGVAGTIPNLDEVIGLTETDEEEEKSSEEAEELPPHPHLPTLYGTKQLHQTIITPADKNLTKGPSHIIRVFKEDNTFTTVLCPLETTTAELLSIVQRKFFLDYTSNYQISVYIGNNVKVLEQFEKPLKIQMGLLLLSGYTEEDNLRIIGREDLSFVCKFVVENIYLRSLTHDEEASLSRNYVEVNMQGLNLKNIPIIFHQHTYEIEKLNVADNPSIYIPLDFIQSCNNLTMIDFSRNGASKFPLNFLEAKRLTHLNMEKNFLDELPSRINHLKNLTHVKLNSNQLSSLPKSFGKLRNLQVLNLSSNYFHNYPECISELTCLVELDLSYNDLLSLPESIGKLIHLQKLNVASNKLSKSLPHYLLNLTELKRLDIRFNQITSVDIVGLLPNLEVAYATKNNISTFNDQANSLRLLHFDKNPITEINFSQRMDMLNILDLSKAKITSIAPEFIRKIPNIEKLVLDKNHLVTLPNNIDQLTKLAFLSIFGNQLQSLPVEICHLKSLQYLDLHSNNLQSLPEEIWHLKSLSVLNVSSNILTSFPKPPLAIAKRVKPSSLVDSLMMLTMSDNRLSDDCFEPISFLISLKSLNLTYNDLLEIPEGALRRLTKLNELYLSGNGLTTLPSEDLESLKSLKLLYVNGNKLVTLPAEISKLTNLQHLDVGSNQLKYNISNWPYDWSWHWNKNLKYLNFSGNKRFEIKQSHIKNPETGEDFDSLLVLKQLKVLGLIDVTLTTTSVPDQSVDIRIRTTTSELENVGYGVADTMGMRDNVSCRDLFIQKFRGNENELLICSFDGKCGATNQGHRLSTLCKNILVGMFTDELNKGKGETDEEIYTALRRTFLNLNKEINGILSAKQNNSFTPTSKQPKELQDLSLIYDLKAGVSITVVYIKDKKIYTANVGDIEALLCRSNGDHVLLTNKHDPTNRDEFERIRASGGYVSGDGYLDGELTISRGAGFFNFLPHTHSGPSINDISLASNDEVLIMATRMLWDYITFELAVDIIRSEKDDPMIAAQKLRDYAICYGATDKIAVIIVTFGERKKRGSNILLYNNLGHEADYFGYKKKRVAGAAQDSTLRRLDDEIEPPVGELALIFTDIKNSTLLWDSYPAPMRSAIKTHNSIMRRQLRLVGGYEVKTEGDSFMVAFPSPTSALLWCFNVQQNLLTADWPSEILETDQCCEVTDSEGNIIYRGLSVRMGIHWGSPDCERDVVTQRMDYYGPMVNRTSRVSAVADGGQICVTSDFLDEMNQLYGIHEKIVSGEKTFEEAYQGNVRAGEIIEKEIKGIEENGCHYFELGERKLKGLETPELITLAYTDKLKLRYEIFKKRLGREIDKAHSTRVVGTLPVEIIYGLRTVSLRLENVCSAINGGTYLNEEFEQHSSGMISQKMKTTFKEVDLIALLNHIVTRIESCSSMLYLRQQMSIASGNDGFIDIFNSVPIGNIMDELNQIVEQFNIYKKTIE

SEQ ID NO: 202 - protein, 2100 aa, Arthrobotrys oligospora ATCC 24927
MNMAPLGDHRRDLKVLQGPGGGANGYSSSNPTLTQTPPSASPTGQAWKAVHHSSSFGSNPHDSSFGGVSSVLDDMAKLSGSPEFKQSDIFSPLNMDDSPQAGRNGSGHPGSMDFSYSGNSIDGYYTPGDDRRPSVASVNTTASSTGSKTSLGKRLNGKLHGIFGDAEGGHHNIVHHPHPQHSSTIPITPPPVSQSDTNLPGNKLHYAPTAPVNNPSRPRTPQPPSSDVVPFLFQDANDIQTFGEARIQPELVHDRHRYHRDEQNVDPKSSAHNFFNKKGKTPGKPSSGRDYDGGASDRELPQHRRDLFSSSYGNSTTNLPRASSPSPSLRSLNSGMGSISNAAGHTAASTSGGEKATKRSFLKGMLRGGGKKAKDEEPDANTMSPVAPRKDRHPSIKVGEPVPSSARGVRQEGPKRGTTAPLTSEFNINPAIFALPDYYHGPGNGNNRKALGNTTPSGSKTKKRGDSFEKPLGKDAGKYNNVVLPEATGNLLDIFDLTNMEGIVAQSPAPAHPSTTEASKSKQKQETHGSWNAPDSWAVGGRQQKVAEAHPQEVEEIPEEILRKQSLSQFCIRVFRVDGSFTTLSSNINSTVTDLLHQLGKKSFLQDDLSNYVIILRKGELARILGSNERPLIMQKKLLEQVGYNDEDRVDEIGREDNSYLCRFTFLPSRVSGHSLDPDTGFNNYKYNHVDLSGRNLLTIPIAFYHKANEISSLNLSRNLSLQVPQDFIQACTNLKEVKFRNNEAWDLPSSFAHISRLTYMDISNNRLKNLGNARLHRHESLVALKMANNRIQELPEEFSKFHNLRGLNVASNYLNAIPPLVSKLVTLVELDLSFNKIKEIPEEISSLKALERLILSHNQIAGDLPAGLAGLRVLKELDIRHNNLISVDVLGELDRLETLYSGHNEISAFTCGFERIRTLHLNSSKVTAFTIKSITPTLTYLNLSDNKMTALADNFCDMLPNLEKLVLDKNKINSLPPQIGKLKKLIQLSCASNHLTTLPTEIGQLIDLRVLDLHDNDIAKLPSEIWSMISLTSLNLSSNVLTAFPKLQTTQVPAVQPQPVNDPVQSTENNEYNPLQVIHETSEFTSNGLLSAGSPNTTSRKGSFASVNNALRKASIASKGSDVSTVVGTGTFTPQSRKDSTASSRIANTFASSLRFLYLADNRLGDEVFDEVSLLSELRVLNLSYNRIYDIPSRALTKLVWLNELYLSGNELTSLPTDDLEHIASLKVLHLNSNKFQTLPAELGKIRRLHVLDVGSNALKYNISNWPYDWNWNWNLELRYLNLSGNRRLEIKANFATNGLREQQQSFTDFNALKSLRVLGLMDVTTTNPSFPDQSEDCRVRTSGTQIKNMMYGMADSLGRSEHLSMVDMVVPRFRGNEDEVLFGFYDGQTLPHSGSKVAKFLQEQTIFYLTEEMRKLRAEETPAAALRRAFLAMNRELMLTGLATHEEKTHSPRDRHRGTNAGVQTNLTRDDIQLGATAALVYIKEHDMFIANVGDAMGLLVQTSGEYKLLTKKHDPLSPSELERIRDAGGYVSRSGRVNDHLEISRAFGYLQLIPSVQACPSVEQWKITEADEFLILASKELWDHMSYQTAVYIANQEKGDLMLAAQKLRDFAIGYGATNKIMVMIVEVGGLVKQRRRVGRSTSIVPGMDDDPRQRGARPRKGDLEDDSRWRKFGREIPPPEVDVCLVFTDIKGSTLLWETFPIAMRSAIKSHNDIMREQLRLVGGYEVKTEGDAFMVAFPTVTSALLWTFNVQLTLLSYEAWPPEILRSQQCAEVWASDSDGVKSLVYRGLSVRMGIHFGQPVCERDPITKRMDYFGPMVNRAARIEGVADGGQIAVSMDYLTELKKVDALYPHEETATASKPNDSFGDVTYEDSIRNDLRNLRNANGWIIKPLGEKKLKGLENPEIISLMIPPSLAGRESDKLIEKSPPSETGLTPEMVLPLYDCTLRLEKLCSQLNSKGLMSQFILDGQYSKDMLQKKIQEGGTDPRILEFVEYVVTRIESSITTLYLRSIMKNVPNVDDNGPEESGLGFGSSITSILSSLRVLLESDPRLQIAKSATSSRSNSNASAVDSTVTDDFPSEDYDDCEINEAPFANV

SEQ ID NO: 203 - protein, 2235 aa, Cordyceps militaris CM01
MSELMNIFDLLLLRPKHPPQPAKQQILAYRALPRHPLEIIVVNPSSLHRLRRFAIRLCSALSRPGFLQTHDPSAVTLSPAHLKDMALLVAAGLTRSSSVTIIPATPTPVPPGASRYNIPSRLSIDSTPLVQRYAIIIQTAPLATSPTVGRSPTCSSSSRDDSQVSPTTSTVAARGAMSPSSVNSNLSNHERRFGDFNNYRRDLAILDQPRASNSISSNNPPTALVAPWMSHSNSAPGGNGNSLPLSFYNDSTDSISVNSHQVSPALHPSAPRTGQLSVSYDSPDAIYYNHDARRPSAASVATTASSQGSKASVPRGGFRKLQGFFGEEFPGRDSSESSLPGSIGKDQRSRSYSHTRPGQERHHSNATDREASPASSRPRTPVPAPEVVPFLYQDNTLLLSPRLHFAVSVAPVAPITTSNTIKQDIARYGEAPVRDTMTGPDRDRYMNEGSSREPPPKSSSSARSGHSILPSHHHHHHHRHNKSNDDPRALRPSTSREESAASLQHPRDRGMASVMYKTKSRAQSPTPSASSVPASRTGQTDGHASPGHGKRGILGRLRRHKDREENGSKLRDLPPSTKSLSNKLSKADFARTETPSPIPPEWSAGTPDAARSTTFNNKFPFSKKSRNFRQPDYHDEAIGPTEHRAAGHVYHLDTNLNDMEGILTRPPPLTPLDSSFLKSLEGDIDTGPPDPKGQWDAPDSWAVRRNAEDQTDEAPETEEAACPPDSEEKQSPYCIRIFRSDGTFLTHAMPLDSTVSDVITQVMKKTYVVDGLENYNIIMKKHDLIRVLTPQDRPLLIQKRLFQQVGYEEKDRIEDLGREDNGYLCRFMFLSARESDFHARTMDLGMSQQQKLNYVDLSARNLVTIPISLYLKAADIISLNLSRNLSLDVPRDFIQSCKQLRDIKFNNNEARKLPLSLCRAAKLTYLDVSNNRVEQLDNAELDTLTGLLKMNLANNRLTHIPPYFNAYQSLRTLNISSNFLDTFPKFICELQSLVDLDLSFNSIGELPDGIGQLKNLEKLLITNNRLGSEVPQTFRDLISLRELDIKYNHITNIDVISELPKLEILHAAHNQISSFVGGFERIRLLKLNSNPLNKFEITAPLPTLKTLNLSHAQLASIDSAFAHMMNLEQLVLDKNYFVSLPQQLGALSRLEHFSIANNSVGELPPQIGCLTELRVLDVRGNNISKLPTEIWWANKLEILNASSNVLDNFPKPASRPPRVPGEDSAGPPPSQNGRTGPLVPLSTTPSTEELGDDRRPSQASSTLLSVGPSPTQPDRKSSVTTSSTVTPPPSTSRKDSGMSSRFTNTFAGSLRNLSLADNRLDDDVFDQITLLTELRILNLSYNEEIGDMPQRSIKSWPQLVELYLSGNGLTTLPADDLEETSLLQALYINGNKFTNLPADISRAKKLAVLDCGNNSLKYNISNVPYDWNWNLNPNLRYLNLSGNKRLEIKQSAWGPGGPGAVNREEYTDFSRLLNLRVLGLMDVTLTQPSIPDQSEDKRVRTSGSLAGHLPYGMADTLGKNEHLSTVDLVVPRFNSSDTEMLLGLFDGQALSSGGSKIAKYLHENFGHIFAMELKALKTRKNETPVDALRRAFLSLNKDLVSIAVQHAEDRPKKSHRGSAQPVVLSKEDLNSGGVATVLYLQGMDLYVANIGNAQAMVIQTDGKHQMLTHKHDPAEPSERSRIREAGGWVSRNGRLNDLLEVSRAFGYVDLMPAVQAAPHVRQMTIQEHDEIILIATSELWEYLSPGLITDVARSERQDLMRAAQKLRDLAMAYGSSGKIMVMMISIADLKRRMERSRLHRGTSMSLYPSGVPDDAQVLSTRRGRKTKGDVLDSSLNRLEAEITAPTGNVSIVFTDIKNSTTLWEMYPTAMRSGIKLHNEVMRRQLRRIGGYEVKTEGDAFMVSFPTGTSALLWCFAVQNELLEVTWPSEILSSMSGQAVYDKDNTLIFKGLSVRMGIHFGDCVSETDPVTRRMDYFGPMVNKASRISAVADGGQITVSSDFISEIQRCLENYQDTDRSGSAGSEEGYDDESYASAIRKDLRSLTSQGFEVKEMGEKKLKGLENPEIVYSLYPHALAGRTEYHTQHERRDELEKPAAVAPGGDLSFDPENIWALWKISLRLEMLCSTLEEVRGPGLQPPETELMERLKTRGGEVTERFLVNFMEHQVSRIETCVSTLAMRHLAKGNVVLKELNDLRAPMAAIFDHFKKQQEELARYRQLYGPLPDDNTKQIEASSD

SEQ ID NO: 204 - protein, 2142 aa, Botryotinia fuckeliana
MTRKDGSCRNSSATSSSTGSWKSTDTIKGPGYFQGSSMKRGAPMQVKTDRSRVEIDAQVSPTSAGPRNTISPSSSISPNVSPREQRMADFGNYRRDLAVLETSGGRIPQIHHNPPTAIASSNQIAPWMSNGGGATGSPNGFTSFYNDSSDALSQASQLSPVARPGTAVTGNTNASDSPADALFGDGDERRPSVASITTASSTGSKGSVSRAVGGLHKKLTSFFGEDPTSSDTSLPSQQGKEARSHSFARSHRDRNHSSATDHGHYRDASPAGGSRPRTPVPSSEVVPFLYQNSQDISLYGEAPVRENLSGPDRERYINDSSDKPPKTSSSSKSHHLPGHHLRNRSNDDTRSLRPTISREESAFSNRFKDRNNPMGTVSANASNPNLQRPKSPTPSGMSTWSQPTKNGNGDAPSSPRDNNNGAKRSLLNLTGRFKRHKDKDHTPSRLKETPAPSRAPINGSSRQDAGRIYESPDLAKYSQDGSITGSELNLTPQYTNGSARPPAGRQGTFPKLPFRKGRGRAEDTDQTYDTLDRGGDNIHHLDTNLSNMEGILTKPPPLTPLDNNIFNGNGHDDENKTDAESAGGLGWNAPDSWAVKKVDDDNMSRLPEIDEAGIPQKADEKASPYCIRIFKVDGTFATLSTALNTTVTELVAQLNKKTYQADNLENYQIVMRKHDLQRILAPGERPLVIQRRLLEQAGYEPGDRIEDVGREDNSYLCRFSFLPARQGGYASVSNDNGLALKSQKYSHVDLSGRNLITIPIALYSKTSEMISLDLSRNLSLDVPKDFISSCVNLRDIKFRSNEAWKLPVSLTRGSRVTMLDLTNNRIENLDHAELSRLQGLVSLKFANNRLKSLPSYFGIYRSMRTLNLSSNFLEEFPEFLCNMVSLTDMDMSFNGISDLPVEIGKLTALERFVFTNNRLKGSLPNSFGKLVNLKEVDIRYNLLSSIDIVATLPKVEQISADHNSVSVCECEFANIRILRLNSNPVTKFEIKNSVPTLTTLNLSNAKLAQIPDAAFDKMPNLNKLVLDINHFVSLPAQIGKLRKLEYFSIARNSLSSLPAELGCLTELRYLDIRQNNLKKLPMEIWWANKLEFLNVSSNVLENFPKPGSRPPQPPGDVGSANNNLNPNSQNSSFEELGPLDFGHRRPSQASSGLLSVGSSPVPDARKGSVVSVYGKGGRKTSVVSRSTSASTINQPPPVNIRKDSGLSAKLVNTFAGSLRNLHLADNGLDDDVFDELTLLSELRVLNLSYNDLNDMPSRSIKSWPQLVELYLSGNELTSLPSDDFEEFSLLQVLHINGNKFQTLPAELGKAHRLTVLDCGSNSLKYNVSNWPYDWNWNWNTNLKYLNLSGNKRLEIKPSLPGSAGARDGRDLTDFSALQSLRILGLMDVTLTIPSIPDQTEDRRVRTSGSLAGQLAYGMADSLGNDSHLSIIDMVVPRFNSTETETLLGMFDGAISSNRGSRIAKYLHENFGHIFSDELKRLNALNNETPKDALRRAFLSLNKDLATAAAQSNEERAVLSQRGSTTPAVLSQDDLTSGGVATIMFLQQSELYVANVGDAQAMLIHEKDGHRILTRKHDPAEPNERQRIRDAGGWVSKQGKLNDVLEVSRAFGYVHLLPAVQAAPHVTHVTIKEQDEMVLIASRELWEYLSPELVVDIARYEKHDLMRAAQRLRDLAIAFGASGKIMVMMMGVSDLKKRAQIRPHRVQSLSFNPNMMMDEGYVPSKRPKKKINDIEDSSLRRLKQEVQAPVGDIGIVFTDIKSSTALWETYPNAMRSAIRLHNEVMRRQLRIIGGYEVKTEGDAFMVSFPTATSALLWCFAVQAALLEVNWPAEVITSHMGHEVYDSNQNLIFKGLSVRMGAHWGRPVCENDPVTRRMDYFGPMVNRAARISAVADGGQITVSADFISEIQRCLETYSESDRSGSTGSEDAFDSDLISQSIRRELRSLSSQGFEVKDMGERKLKGLENPEYIYLMYPHSLAGRMNSQRSLEGEAAVITEEPATLAPDSELTIDPAHVWDIWRLSLRLEMLCSTLEEPRGEPLQPPETAMLEKMKNRGGEVTDRFLLNFLTHQVSRIETCITAIATRHLALGQIAISDLDQLRAPMADVMEGLAADLRELQQYRAKYGPLEPSSVYESEDDFETV

SEQ ID NO: 205 - protein, 2301 aa, Neurospora tetrasperma FGSC 2509
MTRNDGGSRYSSIDSAQSSITAKPFPLTPTGSSLGSSMTRPLSPSLQAGSSSSNGGHNVSRSASQGSRRPAPTRLKSDDGTQFASRSSRDFESSQSQSQPSHTQTRSHSLSQATLQSCSQPQLSLNSQQSQSPSQYYSQQTPTQQQPQQQVSPTGGSRLTQSPTTPSNASIREHRMSELGGYRREMAAMLDTTGGALSRTSSHSQQQPQQPQQQQQQQQQQQGHAAGSVSGTFSNLGQYAPYLGGNNGGGMSMGSFLNDSTDNLSVISQLSPGIRPMTARPSQASAGSMEFPDSAYYDDERRPSIASITTTASSQGSRTSKTRGGLQKLQQFFGDRDDWPGRDSSEISLPQPSHSGPMSTGKEHRSHSYSLPGSGRSHRDRNYSNATDHHPSTFGSVSTVGGRDRDASPVPSRPRTPVPAPEVVPFLYQEADDIARYGEAPVRTSLTGPDRDRYIDSSQNPPKTSSSARSGHSIVHLPGHHKHNKSNEDPRALKPSLSREDSAASFARDFRNGSSSMMGTRSRAQSPAPSWTGTSRGLKANSISDGTSSPAPSHKKGILGRFRRHNKDKEDGSSLRSGSNHTLVHRPSRQDLTRAAESTYPASVYVSDPSEQREVPVRPGYVRQTTAPGFTTKLFTSKKSSSAKQPQDDMDEDIGPTDMHMGGGTVYHLDTNLNDMEGILTKPQPMTPLDNSISMRRESEKMIVPITTDPEGAWAAPDSWAVRDNKKSLAPQVNEDLCSRQPTEEKEKKSNYYIRVFRSDSTWTTLTLPLTATAEDVIMGVAKKTYLPPGAQDSYSLLIKKHDLFRVLNSAEQPLRIQKRLFQQIGYQEKDGIDEIGREDNSYICRWVFLKEKEADMHLLSPDINFRNQKLNHVDLSGRNLITIPVPLYRKAAEIVSLNLSRNLSLDVPRDFIQACTALRDIKYNNNEAQALPKSFATASKLTYLDVSNNRLQDLDHSELSKLTGLLKLNLANNCLRSLPPTLGAYKSLRTLNISSNFLDVFPSFICELETIVDLDLSFNSINNLPDNLMKLRNLEKFVITNNRLSGPISESVRDLVSLRELDIRYNQISTIDVLSDLPRLEILSADHNQISKFSGSFERLRSLKLNSNPIVKFEVKAPVPTLKILNLSNAQLASIDESIDNLMNLERLILDSNYFVSLPNQIGNLKKLDHLSMANNHLGELPPEIGCLTELRTLDVHGNNMRKLPNEIWWANKLEHLNASSNILTEFPKPASRAPQAPGEASPSPGAYPFPNGNKNGLLSRTPSMDDLNGDASRRPSQASSTLLGVAVSPVPPGPDNRKSSMVSLYGKGGRKTSVVSRSTTQSSTGVITPSNGPRKDSSLSYRFTHTFSGSLKNLYLADNQLDDDVFEELKHLPELRVLNLSCNDLSDMPQGTIRSWPQLVELYLSGNELTSLPAEDFLEEHCLLQTLHINGNKFINLPAEISRAKKLQVLDCSSNNLKYNVTNVPYDWNWNFNRDLRYLNLSGNKRLEIKNNYRQPQSYRDDDFADTDFSKLTNLRVLGLMEVTHTLPNIPDQTEDRRVRTSEMKAGAYLPYGMADTLGKNEHLSLFDLVVPRLGSVETDTLVALFDGKELSTGGSKIAKFLYEEFSRLFILELEKVKGKPNENPADALRRTFLSVNKLLMSLSNSADERGLDSHPSRNYAHTVLTKEDLNSGCVATVAYLSELKLYVANVGDVQGMLIQANGSFKMLTKKHDPADPVERSRIRNAGGWVSRNGRLNDVLNVSRAFGYTELLPAVQAAPDITEHTIDDKDETVLIASKELWEHLRPELIVDVARECRSDLMKASQKLRDLAIAYGSTNKLLIMMIGVANLKQRQAQQFKGQLNATFSMPQDDPSHVPPSGNKRRKVRAEGPLDSNLMRLNAEVPPPTGQLSIVFTDIKNSTQLWENYPEAMRLAIKLHNEVMRRQLRMIGGFEVKTEGDAFMVSFPTATSALLWCFAVQMKLLTVDWPPEVLSNSSCQPIYDRNNNLITRGLSVRMGAHWGEPLAERDPVTRRMDYYGPMVNKASRISAVADGGQITASSDFITEIHRCLETYKESVDVDEDSLEDDATAKAIRAELRALSSQGFEVKDMGEKKLKGLENPELVYSVYPHALVGRTEQHHAHIESTQNTAALQPYGALATPKPATMDPDSEIQFEPETIWALWRVALRLEMLCSTLEEPNARGLQAPETELLERMKQRAGEVTDHFLLNFMEHQISRIETCITSLTVRHIAIGSGPITKLNDLRAPMNDVLSTLKEQMDELARYKAKYGSLDQADTDDATDNNSSGDVDTLDGSDTEQE

SEQ ID NO: 206 - protein, 1884 aa, Piriformospora indica DSM 11827
MPRRSSHVDGPDHWSMIFLHNNSGEFPPSGLAPLDPRAQDPDIAPWAELAPEDEAGSVVPSTSSAAGAPGLSGKRTFYAKTSSFSGSLFGRQQQHRDSDVQDSQSLAANENKKSFLGGFKGLRRKNSKPSLAKEPSFSVPAQPVPPLPNSTLPAPRLSPSIPVTRKPRKASKQKMAPPVPPKDHTDDIYLDTNLDRLEGIVDPSRLGADSRVSFSNEAALGGANDDPLNGPFDSYRPRASHSAHGHGPGSNGSNDLWNGHSNNLASTPAMFSIPPAYNGAAFTNPFAGGASNAAAASKRPPPRLATTSPRGKATLLPPSHLEPNGTFLHHTSAISPIDKRDPADPASPSWVAPESWAVKMNMDEEVQSDSGESDNMQLQEPTRHAALFNQEEEQSVHDTTTGALRSVNGGTGAMEYKIRITYETEAGNPHSIYKIPYSETAQSFIKTKFNPKMRIDGECRLWIRDRGKDRMLAGTERILPLLRKRLLMAGYDDDELPNIAGEDLGHIFKLIVRDVAWRADSEEPANITNPAFVDLTGMNLTKVPILLHRVAQHIVLLNLSRNIGIDLPSDFIQSCEALRELKLAGVGLRRVPPAIRHSRHLMRLDISSNRIADLEDSGLDSIPTLSSLKLQCNRLTNLPHYFAAMHAITDLNISNNKLDGFPDVLFSMSSLKDLDVSYNNICAFPPGIGKLVNLQRLTIIGNQLTAFVPELSKLTNLEVLDCRRNMITDLSLAASLPKLKQFHAHYNALHALDMTVGPALTELKAPHNQITRFRLLSPNSAVNLIHLDLSYTKLSSLDEDVVAQLTNLATLRLDHNHFRTLPASLCKLTYLQHLSCSNNVLDELPSDIGSLDNLQILDVHSNSIHQIPASIWQCKSLYLFNATSNLIDVWRNPPTGTQGSTSAPVPFGSISDVALTANSPDSERRPSQPGLFNGRPSKRALPLEMSLQKLYLSDNHLRDDSINFLARLTQLRVLNVSFNDIQDLSSSWLSKLTLLEQLYLSGNRLSALPVEGLQNLTRLHTLYLNANRLQTLPSALNKISSLTVLDVGSNNLRYNINNWHFDWNWNFNRNLKYLNLSGNTRLEIRPDSTKRNHLDRMEGPVLHEFNALTQLKVLGLMDVTIGFMNSIPDDNEERRVRTSGSEVNGMGYGIADSMGKRDQLSMFDIVVPSFRMHEKECLFGMYGRPEPTHGNTRLSKFVQDRFHNELIMKLNQLRPEADEGVVQAFRRAFLSMNRELYKFLTNNSFGQFSRKMSAASSSSTGPNAGIDMTVLKTGLSAIIIYIVDKTMYVANVGNALAVMSRQGEAHLVSYRHDPLDRNELSRIRGTEGWVSPKELLNDELNVSRAFGMYHLLPSVIARPAVTEWDITDQDEFVIVGNCNLWDYLPYQNAVDIARECQDPMVAAQKLRDMAISYGADGSVMVMVLSISDLFPAKAVQRKNAMETGEFGGFKSPLRGNHEPISSKMLNRLPDEVDAPVGTVALVFTDIANSTHLWEKNAGMRTAMLMHNELLRRQLLNIGGYLVKTEGDAFMCSFPTVASALLWCLTVQLALLKLEWPLEILESQDGREICDSDGTVLARGLSVRMGLHWGAPLCEPDFITHRMDYFGPMVNRSARICGSAKGGQIMISNDVIRELSQHFSLDDSSPPPAPPKPIDAAAVSDPAAVRERNHIETLRRMQFTITPMGERKLKGIEAPEALSLIWPKELEGRMSLMHEKEDEEVSAAAADANSRVPFSIAQMKQLAMLCVRLETLTSGRVFKPTTARKKTLPPPAGVATMAIVAEEVEGPIDIVPDVNGIRTPDVLQRPTVMEELEEPSVYLTANPELLMPSIKEGATDEYLMLLLDSLSLRIDNALASLYLQQIGGYRRLAPPRIGSIAGLDGGLLQ

SEQ ID NO: 207 - protein, 1641 aa, Candida parapsilosis
MTNPNNLENYRGFHANRRPNNSSNVPPLLHPIKPKFKKKSSSLFNKLIYSRRDTGGDEEEQQEDEESKRDPLLSTSDASVSPTQSGQSSRANSIASDEQDPQQQQQQQPKRKSNSSASSSHSKHKFRLPSLSLDYHPHHISSVSPNSLQMSQPDNPVTPMKMKHDVYSTPSPSDVSQRDQSVSSLHSLGPTDNMMSLDLNLDEMRDIVKTDETTAPKQNWKAPDSWDVKASKIEEIPEEITEPDFVEKSLPVLYGTRQGSHVSKSMDPHPSHIIRIFKEDNTFTTILCPLETTTTELLAIVQKKFFLESASNYQLSVHIGNCVKVLESFEKPIKIQTGLLLLSGYTEDDNLRIIGRGDMSFVCKFVVENIYLRSLTHEEEALLSKNYVDVNISSLNLKNIPIIFHQHTYEIEKLNVSENPSIYIPLDFIQSCTNLTSVNFSRNGCSKFPTNLLEAVGLTHLNLEMNFLDDLPLKINSLNNLTHLKLNSNQLSSLPKSFGELKNLVYLNLSSNYFVNYPEPVNDLDKLIELDLSYNDLSYLPESMVNLKSLQKLNLCTNKLDKALPDFLAGLQSLKRLDIRYNQIANVDVLGELPNLEVLYASRNSISAFCDRMENLRLLHFDKNPITELKFINQLQMLNILDLSKAKITAIPAEFMIKIPNIEKLVLDKNHLVTLPQELGQLTRLSYLSIYSNNLQAVPSTIGNLSNLQYLNLHSNSIQTLPDEIWNLRSLAVLNVASNNLTSFPKPPFAIAKRISSSNDFGELPASESIADALSVLTISDNRLNDDCFDAISFLVGLKSLNMSYNDLIEIPEGSISRMRRLNELYLSGNDLTTLPADDLEQLKALKLLYINNNKLVSLPAELSKLTNLQHLDVGSNQLKYNISNWPYDWNWHWNKNLKYLNFSGNKRFEIKQSHVKNPETGEDFDSLLVLDQLKVLGLIDVTLTTTSVPEQSVDKRIRTTASELDNIGYGVSDTMGQRDFISNRDLFIQKFRGNEDEVLICSFDGKHGAPNQGHRISLIARNMITKSVTEELSKINNDPDKVYIALRRAFLSFNKEINGILLAKKSHTFTPGPQYSKEQSELNLIDDARSGASATVIYIKNKKLYCANIGDIETLLCQNNGNFRVLTNSHKPTNREEFERIRASGGYVSGSGDLDGDLPVSRGAGYFSYLPHTHSGPDVSELTLTPADDLLVIATKVLWEYISYELAVDIIRQEKNDPMIAAQKLRDFAICYGASDKITVIVLTFGEKTKSNALYNNLGRESDFFKRRRDRQVGGDSTLRRLESEIEPPVGELALVFTDIKNSTLLWDSYPAPMRSAIKTHNSIMRRQLRIVGGYEVKTEGDAFMVAFPSPTSALLWCFNVQQNLLTADWPTEILETDQCCEVTDGAGNVIYRGLSVRMGIHWGSPVCEPDVVTGRMDYFGPMVNRASRISAIADGGQIAVSSNFLDEMRALTAIHDDIKNNVKTISDAYQGNDNAGIIIERELTAIEELGSNYYKIGERKLKGLETPELITLVYSTRLKLRFEIFQKRLDADEKHSTRVIGTIPIECITAINNIALRLENLLSYLNYGTYIKEGLKQNQRLIDPNVQELLNSVTRIENSVATLYLRQLTEPNNNKAFSMSPLSQILDELSAIMKHVQDT

SEQ ID NO: 208 - protein, 2490 aa, Mixia osmundae IAM 14324
MSLTASRLIQLEWQQRLAASMGSHANSQASPISDRQSAQISPTDELQVETPCEVEHKFLNEDSVTLDYLAELDEFTLVAPAGISLVPISAPNGGRMDSGQARQSRTSLRLGHRRRSSAVIIKSVLVKLKNRLSSRPTSSSHLSMPVPDEELGSPAGPTLTSRLSSQGILRHSRSFSQPVFSAREAGTVKFEMHSHKHRSLNSIIPIDGGPGAAPLSVSTRYSMPDYLSVAPSMLLEGSHAHIEHLHPPERHSSLPISVARRVSHATLTKGLKRAPSQPMISKPLRKASQVDLAPKHPELDLSISPGAQGGCGKTLPTRPLVRGRDPAFPVNRPTITKRRRLSGLPTSARPFAVQPVPSDNVFDHYGIGETEEAREELCIRHHRDFELRAKPAAGDLASRRDGPLPALNLGTLPGALGSDTAQAAMSGSGSSSKVLELMGDGPATPSEIDEASHANFWSGRKASHAKSARDGSPSASRRTSRAQSGSLRPLEANSPSNGDRRTSAFPHLHMSPKRRKPSDNTAMPGGPVDSLRKSMDDGTSPRASFSASMPPKTAPDAIKPFAASPTDSSKLARPAFSLRTESSDKIATFRALKVQHATQQAHGMPLGAPLYSPGDTSAPLPGDLSPRAMDDSWLGRTPGQRSLSIASILSESEASLGTASPNSQQRVSNYPAETPSAGEMKDIVPFLYPEPEELSPTELSRSRHASISQQAIKRPSLMRNGKSSSRLNIEPLDLSGAGAKAHKRGLLAMLRRKSSAKDALHDSFRTAGGSFSSITSGIAPEDQSRRNSPPKLVPRTQELRSKRKSGKERQDSLSVPPNNGMSLDTNLSSMDGIINFDATPRSASRDMDGIPPSRTGSFLDKPYPPGRRRPSTAPSLPAPSEGAAVFTLADTRSRKAPALAGDGIWQAGYGTTFGGIVGKDTPSTQTRRPSYVSSDGNGATDIRRGSTSTMTSVSGVGGVDLASKPGNFVPGAAWTAPESWAVKGDLVPDADSTDSDEIGDDDGEGEEKQDKDQPGDLDASVISLPAASRIATRRGSAISLRGQSSGRVDGSTKRPSTGTSTVFRMPNFTIRVYKADQVHATISAPVSTTAHELQTMIARRPGFVTLKGASYKIFIREHGLERVMAGTERPLLLQRRRLEQAGYADIDRPEDLGREDHSYLCKFSFKAETAFTFEAAEETWEGFQYIDLQARSLSTVPIFLYRHAHEIVSLNLSRNPKIDLPADFVQLCTNLRELRLSNLTIKKLPQSIRECPSLTRLDASNNRIVELDHIQLDEVTELTSLKFHNNRLWSLPAYFSKITGLKYLNISNNKFDTFPPVIASLVSLVDLDVSFNLLTELPESMADLLQLQRLIISGNAIARLPASFAKLVELRELDCRRNILEDLSVLAGMPKLETLRCEHNQITSLSLDSPAMLALEAAHNAITKIALVQMASSLTSINLSHAKLTSLDDIFFRELKSLTALVLDNNQLKTLSESLTELERLASFSCRNNLLEALPESIGNLVHLTHLDVSRNDLSALPSSIWLCPEIVSLTACSNLLTTLPDVPSPVEAEGERKQSVAAGGREKPPMALSLQKLYLADNQLPDGTLAAVATISELRVLNLSFNEIYELKRGSLSKLKLLEELYLSGNELTTLPEEDFARLTDLRILFLNGNKLQTLPAELGEITRLEALDVGNNMLKYNIANWSYDWNWNWNLELRYLNLSGNQRLEIKPADVRAMQAQDGLSAAKRRNLSNFNALRKLRILGLIDVTLTIPVIPDDTEDRRVRTSLSEINQMAYGIADTLGKAHSLGMADLVVPRFRGKEDEALFGLFDGRVHTNTGGCRLAKYLQDCFAASMSFELNKLREGESVEEAMRRTFLNINRDYGNILQPLFDIKRKESGDNAGDRALAVGTSAADVRSGASAVVAYISKKQLVVANVGDALAVISGRSGSARVLSAHHTPMDPAETANIRAAEGWVSPKGLVNDEVEVSRSFGCFHVFPAISVRPAVFTVDLADTDDFVILANRGLWDYMSYQGAVDVARSERADPMLAAQKLRDLAIGYGSNQNIMVMVVSVGDLFKQKKPLSRGIGGAQAAGDDDYQTERRRRGFGNAPGERYLTLLDREVPPPVGTLALVFTDIVNSTSLWETNPGMQMAMRMHNQLLRRQLRAIGGYEVKTEGDAFMVSFPTISAAMLWCFTVQLELLREDWPTSILNSEDGKEVLGANGEMLYRGLSVRMGIHWGQPVCEADPITRRMDYFGPMVNRSARIGAVADGGQIVASADAIELIKAMIDPSDLIDARNGSEEDGDWQSNLDEKSQRDILAIRKMGFGITELGDRRLKGLETPEFLSLIYPKELANRIKSVSAGQLGASSKPAEIYDPIPQIIDVNHVRQLAFICLRLEALSAGNAPEAQTAFMSLPVGASPLVGVNSRDHFHYKTRVHPHLLTYPTRADATDEELLAVVESLLVRIENVLATYTLRQLGPYADVLSVLSELTRQDPKYVLHALSLFAQTA

SEQ ID NO: 209 - protein, 2141 aa, Trichoderma atroviride IMI 206040
MADHEAAFRISSGTSASTDSTRSSLTAKPSTPTTATAEAASRTAPPAHIDTEASTPQHYKSLSRDDDLQISPTTSTATTRGAISPTTSRESGRRLSDLTNYRRDLAVLDPLRGHSNPSNYPASLLDESADTMSLFSQYSAGLHGLGSRTGASSSLGLHDSPEHLYSPDDRRPSEASVTTTASSTGSKASGHRGNMRKLQGFFGEEFPGRDSSESSLPSYMGKDQRSRSYSHTRPTHRDRNYSNATDHTRDASPASSRPRTPVPAPEVVPFLYQDNNDIARYGEAPVRDIMTGPDRDRYMSDGAPQVPPKSSSSSRAGIVHLPSHYHRHNKSIDDPRSLRPSTSREDSTSSSYPRDRGAMTGTIFSSSRSRAQSPTPSTHSAHTPYSKSSQVEGHASPGHHGKLGLLNRFRRHKDKDEGNAGGSKLKDLPQSTRSLQTKSSKTDLTRPELSPSAFPSTFVLGSGDVSDASETRSLAGPRAATFKNNFPFSKNRRPPRPFECDDTIGPTDRADPGHMYHLDTNLNDMEGILAKPPPLTPMDTSFVNNVDPDSIDSAVSAPKGRWDAPDSWAVRRGTEDTTVQQPEVEDLSSPPRPEEKLTPYFIRIFRSDGTFSTHSMALDATVGDVISQVIKKTYVVDGLENYHIIMRKHDLIRVLTPGERPLLIQKRLLQQLGYEEKDRIEDLGREDIGYLCRFMFLSARESDFHSKTADLGIQKAQKINYVDLSGRNLVTIPISLYLRANEIISLNLSRNLSLDVPRDFIQSCKNLRDIKFNNNEARKLPLSLGRAARLTYLDASNNRLEQLEHAELNALGGLLKMNLANNRLSHLPPYFGAYQALRSLNLSSNFLDSFPPFLCELQSLVDLDLSFNSISELPEEIGQLKNLEKLLITNNHLSDSVPDTFRDLISLRELDIKYNYITNIDIISELPKLEILYAAHNHISAFVGKFERIRQLKLNSNPLNKFEIQESLPTLKTLNLSQGQLASIDSAFANMPNLERLVLDKNHFVSLPPQIGALTRLEHFSIAHNSVGELPPQIGCLTELRVLDVRDNNISKLPMEIWFANRLETFNASSNMLETFPKPASRAPRLPGEEGQVPPPASNGKALPSGTLSATGSSDELGEERRPSQASSTTLLSVGPTPNIPGADRKSSVVSVYGKGGRKTSVMSRGTTQSQNTVSTSAQSLRKDSGLSSRLTTTFSGSLRNLYLADNRLDDDVFDQITLLAELRVLNLSYNWEISDMPQRSMKSWPQLVELYLSGNVLTSLPADDLEETSLLQTLYINGNKFTNLPADISRAKKLAVLDCGNNSLKYNIANVPYDWNWNLNPNLRYLNLSGNKRLEIKQTAWGGIDGPGAVNREEYTDFNRLPNLRILGLMDVTLTQPSIPDQSEDRRVRTSGSLAGHLPYGMADTLGKNEHLSTVDLVVPRFNSSETEMLLGLFDGQALSSGGSKIAKYLHENFGLIFAQELKALKTRQSETPADALRRAFLALNKELVTAAVQYTDDRKKKSHRGVTQPVILSREDLNSGGVATVLYLQGTELYVANVGDVQAMVIKTDSKHHILTRKHDPAEATERSRIREAGGWVSRNGRLNDVLQVSRAFGYVDLMPAVQAAPHVTNMTIRENDDIIVMATSELWEYLPPGLITDIARAERQDLMRAAQKLRDLAMAYGASGKIMVMMISVVDLKRRVERSRLHRGTSMSLYPSGVPAEAPYLLSTRRGRKGKGDVLDSSLNRLEAEIPAPTGNVSIAFTDIKNSTTLWEMYPNAMRSAIKLHNEVMRRQLRRIGGYEVKTEGDAFMVSFPTATSALLWCFAVQMELLDVPWPSEVLNSMSCQPIYDKDNALIFKGLSVRMGIHYGDCVCETDPVTRRMDYFGPMVNKASRISAVADGGQITVSSDFISEIQRCLENYQDTDRNISAGSEASFEDESLAATIRKDLRSLTSQGFEVKEMGEKKLKGLENPEIVYSLYPHALTGRIDYHLQHERQVETADKPTAILGGGELSFDPDAIWSLWKVSLRLEMLCSTLETVRGPGLQPPETELLERMKNRGGEVTERFLINFMEHQVSRIETCVSTLTMRHLAIGGGTLRELNQLRAPMAAVFEAFMAQKEELERYKQKYGELDDDDRSNGVMTADSLEELEDGSDTEQE

SEQ ID NO: 210 - protein, 1942 aa, Millerozyma farinosa CBS 7064
MSFLRRDKSKSNIKNLNNTTAGQLPVQGSADSGENDRTERGTLEGLSLWGRGRNKSHLAPEKYPNEIQEDGNPGDEAAQVRASSQSSEGSWEQQKRSAIQSDNSGDDKTFVFRKTAGQGNSTSASGAAAANDVGYSPRSSIVSMNSQGNSEGEGTDSGGKLKESYKGFHANRGPKGVSNVPPLPYPIKPKFKKSGSLLGKLIHPSRKDNDSSSVDIDMDESSTADNSRTAAGASTRSSNSSAVSPSPGHHVIKRPSLHGSSKMFRIPSISLEHHSGSYEPYLSQNDENKESSNTRKDNGTTDNGTSNTVIPPTFQIDMDLNEMHGIVKSPDSGSPSSTRTENKDMYPLNPKKYSFGQRSKKSGSTSPSQSYNSLKDDHTIDGRTGAWRAPDSWDVKQNDADKSEPLNEIGSEEGDSDGETLSQDYKDRERDSKPSTPLGERDTHNQGRISTGVTDNNKPEKRESEVTKIPPLYGVRSISHNINKSNTKNLTKGPNNIVRIFKEDNTFTTILCPLETSTAELLSIVQRKFFLESTSNYQISVYIGNCVKVLESFERPLKIQMALLLLSGYTDKDNLRIIGREDLSSVCKFVVENIYLRGLTHEEEMVVSKNYVDVNISKLGLKNIPIKFHQHTYEIEQLNVGDNPSIHIPLDFIQSCTNLHTIIYSRNGCSRFPQNILEAKKLTFLDMEKNFLDDIPSRISHLKNLAHLKLNSNQLSALPKSFSRLENLVTLNLSSNYFHKYPEVINELVNLEELDLSYNDLSYIPDSLGKLTRLTMLNLCTNKLSKQLPSSFAKLVSLKKLDIRYNKITNIDVLGTLPELEVVHATKNMISTFNDRMEKLKLLLFDRNPVINLSFENILPNLTILDLSKAKITEIPANFVERISNIEKLVLDKNHLVNLPIEIGNLKKLAYLSLYSNNLQVIPATIGKLSALQYLDLHSNNLQTLPNEIWDLRSLSFLNVSSNMLIAFPEPPVSVVKRISNAAKFDSSFGDVTDGLESNEVIKVRGSVSEASSDESAELISESELNTDNDSASHLMANQSSSLASSLLILTLADNRLNDDCFEPISFLAELKILNLSYNDIIEFPEGAARRMVKLTDLYLSGNQLSSLPADELENLKSLKLLYLNNNKLTSLPAELSKLKALQHLDVGSNLLKYNIANWPYDWNWCWNKNLKYLNFSGNKRFEIKESHVKNPETGEDFDSLLVLKHLKVLGLIDITLTTPSVPDYGIDVRIRTTASELDNIGYGVSDGMGMRDYISLRDVFIQKFRGNENEALICSFDGKRGTPNMGHRISYLCKNLFVPNFTRELNNLKDDEGIQDAMRRSFLSLNKEINGILSAKKNNNFNPSISNNPELAELDLVTDTNAGCAITVIYIKDKKLYTANIGDIEAVLSRNNGDHVLLSKKDDPTSREEFERIRASGGCVTGDGALDGELTISRGVGFFNYLPHTHSGPHIKEIDLTTADDMIVVASKSLWDHVSYELAVDILRQEKSDPMIAAQKLRDYAICYGATDKIGVIVLTLGEKKSNKLKFGTNGLYNNLARQQDIFANKKRRDRLQPSAGDSSIRRLEEEIEPPEGELALVFTDIKNSTLLWDTYPVAMRSAIKIHNKVMRRQLRIVGGYEVKTEGDSFMVSFPSPTSALLWCLNVQQQLLKEDWPSEILETDQCFEVTDANGVIINRGLSVRMGIHWGSPVCELDYVTRRMDYFGPMVNRASRISTTADGGQISISSDFLMEMRSLMNIHQDIVAGKTTLKDAYQGNVRAGEIIEREIQSIEEIGVSYFELGEKKLKGLETPELITLIYPKKLESRFQMFKQNITQVEQPGTRRKFIATLPVDSVYDLRAISLRLEAICSTLNGTAFSHEGFRTHTSTILNKQSDNLFHDSDFISLFNHVVTRIENCIGTFYLRQQLSLLSGKNGLINFKDAKPLMEELDFLKDQLKLSNLDN

SEQ ID NO: 211 - protein, 1929 aa, Eremothecium cymbalariae DBVPG#7215
MSSSDNNHGERGEDDWRQNIGANQENVSISSGSAVVPFKEHYTLGVGASTDDAWSNSSDNVGDDVSKESSKEQHRAHYYGADGQESQDGQDGQHGSSSVPKGGDSVVEGSSHLRHYRGLHHATFSRTSQYPTSPLANQIKASEKKNSELPSVHIPTPAVYVNSSPSLDILNERSVEGSRKSNDSGLSQPVTMRKTPSRAGSFFKRLTGRQASLNGVETATSTDADGGCSTVMHSSLRRKMNTFIYGNEPKRDTKSGSVSLPGSIASRRSSATSGASSSPANVLQELPRSSISNSKTTSPTATTHSNVSSTAALMSSHTADVNDTPNIPHSSNGESEISSGQDYLSRNPTFFNLNIDLNNLSDITSAFQSNSDPIGSNSVSSRQTGFKSDKISSACQIHGHTSPGDLHSKHNAQWTAPESWDIDDQVLKSNKQKQKCQNPNHHRHHHRHRHQYQSRTPNLVSSPGPQEGSSSTNMGALRSPIHTADTQSKSQSRTTSIRSPIQRAMSPISVISSESIASSHSGSCEMSVGSTAEGSMKDSKVMRSDSTNSFTTVGTELNDAEDDNAQFRLEKYYNDMSDIDYQKRYAIRIFNTDDTFTTLSCTPDTTVGDMIPQIKRKFNVTQGNFQVSLKVGKMSKVLRPTAKPILIQLRLLLLNGYKKTDPLNIMGIEDLSFVFSFIFHPVITSQLAYEQEQRLIKGEFVHIDLRSMDLTLPPIIFYQHMSDIESIDVSNNANIFLPLDFIESVIKLSSLRMVNIRASKFPANICEANKLVSLDLERNFISKVPDSISKLSNLTMLNLKCNELEKLPRGFKDLKNLQLLEISSNKFNAYPEVINKCTNLLQINLSYNKIKSIPLSINQLTKLAKINLSNNRITTLGDLSGMKNLRTLNLRCNRIESIKCRAPNLQNLFLTDNRLSVFDDDLIMIRSLELQENPITFLSLKSNYLQNMASLSINKAKLSSLPGDLLQRMPRLEKLEINENNLTTLPPEIKYVKKLVHLSVVKNKLESLPEELSQLKNLKMLDVHCNNLLLLPYGTSSLPLTYMNVSSNLLSGSADIYRDIFQPTSNLSRSLMFFSAADNQMGDKFWELMNNLKALKVLNLSYNNFMSLPELDMENLTELYLSGNHLSTLSGDAFLKLKSLKVLMLNGNNLQSLPVEISQLPQLAVIDIGSNQLKYNISNYHYDWNWRQNTDLKYLNFSGNTRFEIKSAIDAETKADLSDLTILKKLRVLGLMDVTLNTSKVPDDGVNFRLRTMGSRINGMEYGVADTLGQKDAVSTRDVTFERFRGREDECLICLYDGVNDDTNTGHKISQVVRDIYDRILLRSLEKYGDKTSSEIRDALRFSFLQLNKEINSAITSVDNRNNDSVSLTSADSLSGASVTVVYMKGKKIYTANIGNTTAILSKGNGEYGILTHKHVPTKTEEFERIRISGGYVNNKKLNSVSEISRAVGFFDLLPHVHASPDITESVLTYTDDMLIIATHSLLEYLSHEKVSDVARENKSQPMLAAERMKDYAIAYGCTENITILCVSFNKNVSKQRQFSLNKSDLLGRRINFEESSLRRLQPEIPPPTGHLAIVFTDIKNSTVLWELFPNAMRIAIKAHNDIMRRKLRIFGGYEVKTEGDAFMVAFPTPTSALVWCLTIQLKLLDIQWPEEITSIKSGCMITDDEGTTIYQGLSVRMGIHWGYPVPEIDIVTQRMDYLGPMVNKAARVSSIADGGQITLSSDFIAEFNKIMRYHKMVVEEKKLLKEVYGEEFIGEVLEREIQMLENIGWVFEELGEQKLKGLETREFITISYPKSLAARNTIANKEQSNSIVNDDYMLQLRTISNTLENILSSVNGGLIEIDNRSQQAPDYVARQKAADITSININAETDWISSLDHLVTRLESTVAILQLNQRMEGGLEIYRPGNKTKKSVFELLDQLWPPDKSVHP

SEQ ID NO: 212 - protein, 1942 aa, Naumovozyma dairenensis CBS 421
MPASFRSSKEPSGGSSSTSPHDQKLQHVHILPQGTFIKKINEEAPTFRKEYTQNLNDTTNDSPSDTRRNSTHSLFNPLSISKTMSRDSIASNSQYDIPESIRTTVPTKSKSRKGGHLLQRTLSSLSITGINPSSTQSIPNEGPNYTTAAAQVVPPRKHSFAGGFFKRLSGAGNRGNQKNKEELQQQVPQQQVQQQPIFNARHRQSVSGAVPSALSPIHSNPTLHNEPINLRPPQGTIDTTLDLEDEDKKNTEENEEIPALFPLDTNLENLDEITKAVAPIKSIKDVEKITSSPIQPPKGIENSVIVVDANDEQVPIVSQDNQQGISNGSRPSSVGPKKSHSMADIPLWASSSMLDISGRTTDASQQQWTAPESWDVDSTQKKSKIKSKSRARRAMNQQRNHTNNNNNVLGGTSPNALQRSTTETLGLLNDGAPGSRGSNISERSMVRLRHSLAMSKSNTPILTNKEQSTASVDSNTYSSGKSISSTDSSGYSSSDNDFFDETSIAPISDKPKKGSHRTNENDMMSNFQFRARMDKNGRPATPTNDPFTLLTDTREGSTATTITNNDDEHDKLEFELEKYYKDVSDLNPDKHYAIRIFNTDDTFATLSYPPGTTVQDMIPALKRKFNITSQGSFQISLKVGKLSKILRPTAKPILVERRLVLLSGYMKSDSQDIMGIEDLSFVFKFIFHPVTPSYFTSEQEQQLMKGDFVHVDLRNMDLTTPPIIFYQHTSEIESLDVSNNANIFLPLEFIESAIKLSSLRMVNIRASKFPNNITEAYKLVTLELQRNFIKRVPKSISKLTNLTILNLQCNELERLSSGFANLKNLQLLDLSSNKFTQYPEVINSCKNLLQIDLSYNKIQNLPQSINNLVKLAKINLSHNKLEAINDLSGMTNLRTLNLRYNRVASIKSSAANLQNLFLTDNRISTFEDSLPKLRALELQENPITSILFKSSTLSDAQLPTHLTSLSLSKAKLSHLPGNVFKNLSKLEKLELSENNLSRLPVEIASLSKLVYLSAARNKLEGLPSEFSNLKNLRSLDIHTNNIREFFDGMENIELTFLNISSNAFGSLESEDTFCQNMKADSKLAKSLMFFVAADNHFDDSLIFFFNCFKNLKLLNLSYNNFSDISFLSLEHLTEFYFSGNKLNTLDGDTVVKWKYMKTLMLNRNQLLSLPTELSQLSQLAILDVGSNQLKYNISNYHYDWNWSQNKELKYLNFSGNRRFEIRSFTSHEINADLSDLTILPNLKVLGLMDVTLNTNKVPDENTNFRLRTTASTINGMGYGVADSLGQRNYVCSRDVTFERFRGKQDECLLCLHDSKNQNADYGHNISMIVRDIYDNILVKQLEKYGDSSDDKIKRALRFSFLELNRQINRMLNSVDNGTSVGNLTSADLLSGVCSTVIYIKGKKLYTANIGDCRAMLCKNNGEYEMLTTEHIPSKREEYERIRISGGYVNNGKLDGVVEVSRAVGFFDLLPHIHAAPDISVTSFTGVDETVVIATNKLWEYMDVKTVSDISRENANDPLLAAETMKDYVNAYGYSDNITIMCLALFKRTEDQSRVTLNRNTLRRATVEDATLRRLAPEIPPPTGNLALVFTDIQSSSTLWELYYAAMSTALSIHNDLMRRQLRIYGGYEIKTEGDAFVMAFPTPTSALLWCLSTQLKLLDVAWPEEITSSPNGRLVVDSQGKRIFNGLCVRMGIHWGSPLTVFDLVTQRMDYLGPVVNKASRVSDVGKGGQITLSSDFCSEFKKILALHERAKKECEPLSAIYGDELIGEVLEKELSALEGIGWVFYGDGEHQLKGLESKEFITLVYPKSLESRHQFFQEAEDSTVANKELLLRLNTVYAKLGRIFAFTACTATGDDIWKVIGTKELSSISNLTSIQEKDILPLLVKTIYGIDATTGSIMLYAHKLHGIDATNTADNNFSYSQLIADLLKDDDDIHDSFDNNK

SEQ ID NO: 213 - protein, 1948 aa, Naumovozyma castellii CBS 4309
MGTSSNFSGNARETSTDVRSIASSKKSQSAGGSSFHQVVNDEPPKFKRQYMQQPQSTNRRDSSHSLFTPSLHAATRTMSRDSTVSNSTVDFNENNYYTTNKQQAGENKVRRGPLSLKRTLSSLSMYGSNSASHSADSQQQQQKQQQQQPRKHSFAGNLLKRLSSSVGNSNRTNHHHHHHQHDTINPSIATATATKPPLSQRDPNTLTGFVSSHKPSISTTKSGLLSPINSHPEISNESLKKQNEDTITKDEPQETEEPESLSPTIDNLLNEPTDDENKQSLFKLDTNLEDLSEITNAVVPPGTIIAPIHPHYDTMTQNGKKLEHLHNNTTGPTPIPKMYDTTDDEQGSQLFGVPKKSKSMADIPRDSIKWVPPDSWDVDKNEIKPRSNKALIEGPIKKTIINPNDRENITQRSMSRLKNSLTMSPNTTVNNLRQNNNIANNNNNNNNNANNSINNNVNPNPNVDTAAKNKEIPKVSYQQPLIPLSLRYTEDSESSSEDEYFDESSRNHRLIRRTQIKSTENNKGPKTFTQPKTSTIIKGETAGRASPLSPTAQSNAIMPNAENEVVDLVDDKRHDEVENELEKYYQDFSDLDTGRHYAIRIFNTDDTFATLSYPPTTTVEELLPALKRKFNVPHSGRYRISLKVGKLSKLLKPSAKPILIERKLLLLNGYKKSDPLHIMGIEDLSFVFKFIFHPVTPSSYNEQEESLAKSDFVHVDLRNMDLTTLPIVFYQHTSDIESLDVSTNANILLPKDFIESAIKLTSLRMVNMRASKFPSNITEAYKLVSLELQRNFIRRIPNDIHHLNNLTILNLQCNDLSDLPQGFDQLQNLQLLDLSSNKFSHYPEVINSCAHLLQVDLSYNKIQSLPSSINQLKKIAKINLSHNKLTIINDLSGMKNLRTLNLRFNRIAHLKSNSSTLQNLFLTDNRIAAFEDSLPKLRTLELQENPITSIGFTSIDSTKLSFPTNMTSLSLSKAKLASVPGDLFKNLPYLEKLELNENNLSRLPVEITYLTKLVYLSVARNKLEFLPTEFSSLKSLRSLDIHSNNVREFFVGMENIELTYLNISSNVFGNLSTDVPFYRNLSVDSKLAKSLMFFIAADNQFDDGMWSLFNCFTNLKVLNLSYNNFADVSFLRLANLSELYLSGNKLTALPGDTVLHWKALKTLMVNGNQLLTLPAELSQLQHLTIFDIGSNQLKYNISNHHYDWNWGQNKDLKYLNFSGNRRFEIKSFVSNEIDTDLSDLTVLPQLKVLGLMDVTINTSKVPDENINFRLRTTASMINGMRYGVADTLGQRNYVCSRDVTIERFRGNDDECLLCLHDSKNQSADYGHNISRIVRDIYDKILLRQLEKYGDSTDEEIMTALRFSFLQLNKEINGMLNSVDNGTTVANLTSADLLSGACSTVIYIKGKKLYCANIGDCMAVISKNNGDYRKLTTDHIPTKREEYERIRLSGGYVNNGKLDGVVDVSRAVGFFDLLPHIHASPDISVTELNSSDEMLVLGTHRVWEYMDIESVCDITRENTANPMVVAEELKDHAIAYGCSDNITIMCVSLYRDKNQQDRFTLNKNSLMTRRTTFEDTTLRRLQPEIAPPTGNLAVVFTDIKSSTSLWESFPDAMRTAIKTHNDIMRRQLRIYGGYEVKTGGDAFMVTFPTPTSAMVWCLSVQLKLLDAEWPEEITSSQDGCSILDSTGTKIYKGLSVRMGVHWGCPVPELDMVTQRMDYLGPVVNKAARVSSVADGGQIALSVDFCSEFQKILKLHERVTKGKEQVKEVYGDEVIGEVLERELSMLESIGWVFFDFGEHQLKGLENKEFITMVYPTALASRHEYAIEEDENNGLTKDFVTGVEAISQRLNRILGTIQASLSADNSWQAMATPEWKPNTNVVTGTTEAELAPIFAADVFKIELNVANINFLERTLQGLDINSQNANKAETNIFDLLRVASQKVHEGFDEKK

SEQ ID NO: 214 - protein, 1977 aa, Tetrapisispora phaffii CBS 4417
MQSLDDGRPKGGNNNTGNGNNSNPKETNNKNIPNTLTKTTTTSSSIVSPDSAMNAFSDVNSNLSLGSNSNSDSRLPIRRNSIAATVLSNNSNLYFKTRTNGSQKIINNIKKSKTMNTNYSTQNGSNDNFSLYSANSAVSSVRPGQSQGHGKGNHDRRKKQPNALKKTLSNISMSMFRNSFSAMSPAPSHNNAADNSPGASIDEGQYTYKSPTTSNLNNSSRKFSFAGGLFRKLSTVSTPAASPITGNKNNRDRSGNSSPKTSMIYNKFDNNSARRSQSSKEDIYSSVGARSRKSGEEPSKSVANTVSTSSHNDVNTNPLSLTTQNSDSVFWNEVNKPENGNFDFLNKSVTQDRNQTYNDLSLDLSPTDISSHNVDSATYGNPIASNTTVQRWSAPENWDVEGSNLTSKNKKVNSNRSSTVNLVVNRGNKFRNNSLVLPGDQNKPNKLSNSSESISRYSSDDNDNDSNTKYIQNSEGNDISLVNGKEVNDSTTPIAKVSSRKLNQMHNKLLMTPSNTMSLDVPSNASENPDISSANSPMHTDLEDYGEDDDDDDSDEDESTSGSEAGLPFTLSSSNVAKLAILATRENSVNSNNVSSLPIILTAEDEKRDQAERDLQKYYKDVTDLDPKKHYAIRFFNVDKTFTTLSLTPDTTVQEVLPILRKKFNIASQGNFQLSLKVGKLSKILKPTSRPIIIERKLLLLIGYRKTDPLHIIGIEDLSFVFKFHIHPVAPSHLNAEQEQRLMRSDFVHVDLRRINLTTPPIIFYQHTSEIESLDVSNNSNIFLPLEFIESALNLSSLRMVNLRASKFPANVTEAYKLVSLELQRNFIKKVPTSISNLINLTILNLQCNSLEKLPKGFTKLKNLQLLDLSSNNFVEYPEVVNGCTNLLQMDMSYNKMYSLPNSMNQLIKIAKINFSHNKLTAVGDLSGMKCLRTLNLSNNRITVIKTNASNLQNLMLSDNRISTFDDTLPKLRALDIQENPITSIPYKDFYPMNMTSLTLSKAKLASIPGELFSKLSRLEKLDLSQNNLTKLPSEISNLNKLIYLSVARNKLEGLPAEFSQLKNLRTLDLHSNNIRELVPGCYDIEITYLNISSNAFNTNNFKESLSADLNPNTKISKSLMFFIGADNQFDDSVWSVLNSFANLKILNLSYNNLTDLSGMKLANLNELYLSGNKISNLASDTVLKWQSVRTLMLNGNNLLSLPTELSQLSQLTIFDVGSNKLKYNISNYHYDWNWRENKELRYLNFSGNRRFEIKSSINYDIDVDLSDLTILPQLKILGLMDVTLNTNKVQDENINFRLRTSNSTVNGMAYGVADTLGQKDYVSSRDVTFEKFRGKDDECLICLHDSKTQGVRYGHNVTEIVRDIYDKILKRQLDKYTEDDEGIKNALRFSFLQLNKEINIMLNAVDNGEKVPNLSFVDLLSGTCSTVIYMKGSKVYTANVGDCMSILSKNNGDCNVLTTHHVPYKREEYERIKIAGGYVSNSKLDGAVDVSRAIGFFDLLPHIHASPDISVTTLTSSDDMLVVATHKLWEYMDYETACDITREHSGHPLLAAEEMKDHAIAYGCSDNITILCLSLQKDAQQQGNYSFNRNSLISRRTTFEDTTLRRLQPEIAPPTGNVAIIFTDIKNSTFLWELFPNAMRSVMKTHNDIMRRQLRIYGGYEVKTEGDSFMVAFPTPTSALVWCLSVQLKLLDAEWPEEITSIQDGSLVLDKFDNKIYQGLSVRMGIHWGYPVPELDMVTQRMDYLGPVVNKAARVSGIADGGQIALSNTFCVEFNKILSYHDMVVNKNKSLEEAYGEKLIGEILEKEVAQLVSIGWSFFEFGEQKLKGLESKEYITIAYPKILETRHDYSLTESDEKGLVDGDLLFRLLVVNNKLDFISSAVNQGHIDKEVEESGSYLSNVSDANEASIMSIIADIGFMPFFEQLVTRLETCVAMLQLRQRVQKNLNITQEGANAACASIFELLDEIFAAAGIENK

SEQ ID NO: 215 - protein, 1890 aa, Torulaspora delbrueckii
MTTESGTDRTDREEEPPFKSHYKLQSKEKDTPTHNKNQESNRIRRGPVLLRRTISSLSMSGGGTAKGELPELSATKSHSSGRKRNEEDPFQRPARPLPPSRKRSFAGALFKKFGGSGNPPLESLSQHQDEYDPNEKSESFSDHSARSKDRRASRDSGTSQHAPQPYLADKVKVPSTFRRKVSTLVHGLGHESDHHDEHHSHGPKSSSMSPIKKSLTATDEYTKNSDRPALGRHRTAHLVIPSGSTPSSRRSSTASTMSSNMSESSKQIASERSPTTLHGNGSFFPLDTNLENLSDITAQPTVKNIGKVAPPENTMIREGTNPPPDNTLAKTTSKTSIHEQSPKLKVKQWVAPESWDVESGMERARNKKYSHGEVNSGYRRKNKQPSHLHRALSSSPSLEPSSMSLVRNASNTPSALQHAVAPDNDTTVFNKDTKNLNAYTGNDDDGDDDDDSESSTSESLNSASDYTSSHTESLTGDNLDQSDELDPTSKPNTSSRRQSPGHDSTDELAFSKQVSLVDEKHDKVEYELERYYKDCSDLDLKRHYAIRIFNTDDTFTTLSCTPSTTVREIIPALKRKFNITSQGSYQLSLKIGKLSKILRPLAKPIIIERKLLLLNGYRKTDPLHIMGIEDLSFVFKFLFHPVAPSHLSPEKEQRLMRSDFIHVDLRGMDLTTPPIIFYQHTTEIESLDVSNNGDIFLPLEFIESTIKLTSLRMVNIRASRFPANITEADKLVSLELQRNFIGRIPNSIFQLSNLTILNLQCNELDRLPKGFGQLKNLQLLDASSNRFVHYPEVVNECTNLLQVNLSYNKIHSLPISINNLTKLAKMNLSHNKLTEINDLSGMKNLRTLNLQHNRIASIKTDASNLQNLFLTGNRISSFCDVLPKLRALEIQENPMTSISYQDFYPMSMTSLSLSKAKLASVPGELFVKLSRLEKLDLCENNLTQLPEEISLLNKLVYLSVARNKLESLPAGFPKLISLKTLDLHSNNMRDLVDGLQDLELTTLNISSNVLGNAQLSPMFFNNFTSESKLAKSLMFLLAADNQFDDQMWPLFNCFENLKLLNLSYNNFQDISSLKLENLLNLYFSGNKLSTLSGDVVLKWKSLKTLMLNGNHLLSLPAELSQLSHLNVLDVGCNQLKYNISNYHYDWNWRYNKELKYLNLSGNRRFDIKSFVSQEINADLSDLTVLPNLKILGLMDVTLNTSKVPDENFNLRMRTTGSVLNGMRYGVADTLGQRDFVSSRDVTFERFNGKDDECLICLHDGKNQNATYGHNISKLVRDVYDKILIRQLERYGDTDEDVKKALRFSFLQLNKEINVMLGSVDSGGNVANLTSADLLSGAVSTAVYIKGNKVFTTNIGDCMAILSKNNGDFQRLTKLHVPYKRAEYERIRISGGYVNDDKLDGVVDVSRAVGFFDLLPHIHASPDISLVTLTKADEMLIVATHKLWEYMDFETACDIARENAAEPMLAAAAMKDHAIAYGCSDNLTILCLAFDKSSTDQNRFTLNKSSFMRRSTFEDTTLRRLQAEIMPPTGNLAIVFTDIKNSTFLWELFPNAMRTAIKTHNDIMRRLLRIYGGYEVKTEGDAFMVAFPTPISALVWCMSVQLKLLDAQWPEEITSIQDGRLVVDKDGNKIYQGLSVRMGVHWGCPVPELDLVTQRMDYLGPMVNKAARVEGVANGGQITMSSDFCIEFNKILKFHERVVKDKEPLKDVYGEEFVGEVLEKEIAMLDSIGYVFFEFGEQKLKGLETKEFITICYPKSLASRHNFITEDEQTRMLNEECISKLRTVARKLEAVVSAVNGGFIDVDHRTRTSKLPHVDEGVQNPAHYRSTDSETVTLNYFDHLVTRVESYIALLKLKQTMFHGLDCYKSGENGAMHMSIFELLDKVLEKVEKAP

SEQ ID NO: 216 - protein, 2206 aa, Myceliophthora thermophila ATCC 42464
MPQPDETSRFSSMTGSSTDSGRSSITAKPLPATPTSPSLPNPPGAAGNNNASRHGPHGSRWVAPSRLKTDEGGNPTRSSIKESDGQVSPTSNDARVALSPSSTNSTTSMREHPMSDLRDYRRDLAILDLAGGRSSRTQQQTNPSTGSLGGAASAPPPEPPVPMTFYDDSTDNLSLGSQLSPGVRTSISRATPVGSTDSPEAAYFTDERRPSVASITTTASSQGSRTSGARGGLRKLQGFFGEEFPGRDSSEISLAHPTGGREHRSHSHSYSRPHRDRNYSNATDHGRDASPSSRPRTPVPAPEVVPFLYQEADDIARYGEAPVRDILSGPDRDRYITDSSTQNPPRTSGSGRSGHSIVHLPGHHRHNKSNEDSRSLRPSISREDSTVSAPKDRGGSAAMYGTKSRAQSPAPSAPSGYWTSKAAVGDGQTSPGHHHKRRFLGRLRGKRDKDDSGDLRKLPASAQSLQPRPSRHESPFGDGQQSQGSEWPSTPDPRETHGLRPAFVRGATFNNKFPFSSKKSRTARQRDDLEDNIGPTDRQDTGGTMFHLDTNLNDMEGILSRPVPLTPMNPDFLNEVDFDKLPIKSADPRGAWNAPDSWAVRRGDEAVAQVPEADDIGSPPRPEEKMTNYCIRVFRADGTFATLQMALDATVSDLISQISKKSYVIDGMENYNIVLKKHDLTRVLSSVERPLLIQKRLLQQIGYEERDRIEDIGREDHSYLCRFMFLSARESHFHALTHDVGFGRMQKFSHVDLSGRNLTAIPVILYSRAPEIISLNLSRNLSLDVPRDFIQSCTSLRDIKYTNNEARRLPPSLSWAKKLTYLDVSNNRLEQLEHADLGELTGLLKLNLANNRLSQLPSYFGAYSVLRTLNISSNFLEKFPPFLCNLESLVDLDLSFNLISDFPDAIGKLRNLEKFVVTNNRLTGTFPDSFKNLANLRELDIKYNAITNIDVIAQLPKLEILTADHNSISQFVGSFERLRSLKLNSNPITKFEIKSPAPTLKLLNLSNAQLASIDESFNNMPNLERLILDRNYFVSLPSQIGNLRKLEHFSIAHNSVRQLPQEVGCLTELRVLDVRGNNIRKLPMELWWANKLETLNASSNILDHFPKHASRAPQPPQPPDDARSTSSSVNSKQSSGSRALSSMPSVEELNGDASRRPSQASGATLLSVGPPPVPGADNRKGSMVSLYGKGGRKTSVVSRSTQSSTATTGTGLRKDSGLTALLTNTFAGSLRNLYLADNQLDDDVFDQIMLLSELRVLNLSYNELSDMPQRSIKNWPQLTELYLSGNELTSLPTDDLEDYSLLQTLHINGNKFTNLPADISRARRLAVLDCGSNSLKYNIANVPYDWNWNLNPNLRYLNLSGNRRLEIKQTYPGVVAQNRDQLTDFSRLQNLRVLGLIDVTLTQPSIPDQNEDRRVRTSSSLAGYMPYGMADTLGKNEHLSTIDLVIPRFNSSDSTTLLGLFDGQASSSGGSKIAKYLQENFAHIFAQELRDLKTNQGETAEDALRRAFLALNKDLATAAIQHAEDRPITTHRGSQAPLVLSQEDLNSGGVATVVYLDEQELYVANVGDVQAMLIQTDGQAKMLTKKHDPADPPERSRIRDAGGWVSRQGRLNELLPVSRAFGYVDLMPPVQAAPHIKHHTIGDNDETILLATREVWEYLTPELVVDVARSVRGDLMRAAQKIRDLAMAYGSKDKIMVMMLSVADLKRRRERSRMHRGQSMSWFNFPQDDTAHQVATRRGRKAKAEGPLDSTLQRLEAEVPAPTGMIAIVFTDIKNSTQLWETYPEAMRSAIKLHNEVMRRQLRRIGGFEVKTEGDAFMVSFPTATSALLWCFAVQTQLLTVNWPTEMLNSISCQPTFDRDNKLIFRGLSVRMGIHWGEPLAEPDPVTRRMDYYGPMVNKASRISACADGGQITVSSDFIMEIQRCLETYQESGSSDDSFEDDGFARAIRNELRSLSSQGFEVKDLGEKKLKGLENPEYIYSLYPHALAGRIDQHNLHERAQAAADRPAMLSPDSQLAINPDDIWATWHVALRLEMLCSTFEDVTRRKLHPPETELMERMKRRGGEVTERFLISFLEHQVSRIETCISTLAVRRLVLVEGKPSAKPSDLRAPISDVLETLSDQLALLKKYEARYGPLDDAGEDPSSTQGTTSAVTSLPPPAAAPPSNNNNNNNNNNNSPQVTIPQAAIGSPSASAESGVSTPESSPY

SEQ ID NO: 217 - protein, 1974 aa, Thielavia terrestris NRRL 8126
MREHAMSDLFDYRRDLAILDPAGGRASRAQQQTNPSTGSFGQGPPWMANSSGAASAPTSTDQIPTTFYNDSTDNLSLASQLSPGVRTSISRPTPDIARYGVAPVRDILSGPDRDRYVTDGSSQNPPKTSGSGRSGHSIVHLPGHHHKHNKSNEDPRSLRPSVSREDSTLVPAKERSGSTGMYGARSRAQSPAPSANSTYWSSKNASGDGQTSPGRQPKRRFLGRLRGRREKDDAGDLGKLSSSTQSLLPRPSRHELPFGDRSTPQGSEWPGSPDHRDAYGPRPPFSRAATFNNKFPFSSKKSRAIRQHDDADENIGPTDRQDAGGTVFHLDTNLNDMEGILSKRTPLTPMDTAFLSDLDFDKLPIKPTDPSGAWNAPDSWAVRRGDEASAQVPEADDIGSPPRPEEKLTNYCIRVFRADGTFATLQMALDATVSDLISQIVKKSYVIDGVENYNIILKKHDLVRILSPAERPLLMQKRLLQQVGYEDRDRIEDIGREDNSYICRFMFLSARESGFHAVAHNVGFGRMQKLSHVDLSGRNLTAIPVALYSKAADIISLNLSRNLSLDVPRDFIQACENLRDIKYTNNEARKLPPSLGWANKLTLLDVSNNRLEQLEHVDLGGLTGLLKFNLANNRLSHLPAYFGAYSVLRTLNISSNFLEKLPAFVCDLESLVDLDLSFNLISELPDAIGKLRNLEKFVITNNRLSGSFPSSFRNLSSLRELDIKYNAIANIDVIAQLPKLEILTADHNSVSQFVGTFERLRSLKLNWNPVTKFDIRASVPTLKLLNLSSAQLASIDDSFNNMPSLERLVLDRNYFVSLPSQIGSLKKLEHFSIAHNLIRQLPPEIGCLTELRVLDVRGNNIRKLPMELWYANKLETLNASSNLLDSFPKPASRPPVPPEETASAASSLGSKLSGTTRAVSPMPSVEELNGDASRRPSQASSTLLSVGPSPVPPSGDRKGSMVSLYGKGGRKTSVVSRSTQSSAPPVSGGIRKDSSHSALLTTTFAGSLRHLYLAENSLDDDDWETLMKLHELRVLNLSYNGLNDMPQRALRSWPQLTELYLSGNELTSLPADALEDYSLLQTLHINNNKFINLPADISRARRLAVLDCGSNSLKYNIANVPYDWNWNLNPNLRYLNLSGNRRLEIKQSYPGMVGQTREQYSDFNRLANLRVLGLIDVTLTQPSIPDQSEDRRVRTSSSLAGYMPYGMADTLGKNEHLSTIDLVVPRFNSSDSETLLGLFDGQTLPSSGSKVAKYLHENFGNIFAHELNERKAAQGETPQDAFRRAFLALNKDLITAASQHAEDRSLMTHRGSQASLVLSKEDLNSGAVATVVYITEQELYVANVGDVQAMLIRNDGQYEMLTKKHDPADPQERSRIRDAGGWVSRQGRLNELLPVSRAFGYADFMPAVQAAPHVTHHTIKDQDETILIATREVWEYLSPEHVCDIARTERGDLMRAAQKIRDLAMAYGSKDKIMVMLLGVANLKQRRERSRMHRGQSMSWFNFPQDDNGLPVSSRRGRKTKAEGPLDSTLLRLDAEVPAPTGNIAIVFTDIKNSTQLWENYPDAMRSALKLHNEVMRRQLRLIGGFEVKSEGDAFMVTFATATAALLWCFAVQMQLLTVNWPNEMLNSVTCQPTFDRENRLIFRGLSVRMGIHWGEPLAEQDPVTRRMDYLGPVVNKASRVSACADGGQITVSSDFILEIQRCLETYQETSAEDTFDDDPYARAIRSELRSLSSQGFEVKEMGEKKLKGLENPEYIYSLYPHALAGRIDQHNLHERAQSESEKPATLRDAGLEIRPEDVWELWHVSLRLERLCSALQEAPGRLQPPETELMERIKRRGGEVTERFLLNFMEHQVSRIEACVSTLAVRHLVLANDPTRDPNDLRAPMSEVLDTLAERLALLQRYEARFGPLPHDDGASLGSLSSGLSASAPALLPDRRKRAVDGPDPDTPQPSSASGSDSAGTRVDTPESALGEP

SEQ ID NO: 218 - protein, 1984 aa, Kazachstania africana CBS 2517
MPFPSKYDTDTLPEEKLWKERKEEQDDDGDDDMITQNKPNFIERIHDEDQYFNSAKRGKRLSAQYQGGGPLDRTPSRDSIKSSFPTTNSERSKKQKKKAPLSLRRTLSNLSITNSGHTAGHDKGNDFSYSQHHTDVMPPRKHSFAGSLFKRLSSTGLTSAKPPKTKVTPKKEKLGKVQPKATTAVAPHASPVSSITSFITSRRGSKESVLPPNVSEHISPQVKEKVNTITNTLEPSDTSPIKYNNNKATSNMVPRRSSAIPPLSSTSTSRRNSAISTINASDRSSSQTSKDQPGDTITSSKVQSYNILPVNTIQKNNNEEDNEKGDLKVFNDLDEKIVKNEPQDNKENEETQPKWFPLDTNLEDITDITKPVVENVSIPLPEPSALKQRNSATGGSIENDDITFKANHNRLSARNALLSPKKSHSIANLPAWSGSSNINNIPTFSYKSTNQWIAPQSWDIDQASLPKKSRSKSRKAFKEIDPLAVSGRDRKHHRLRGRNFNLHEGKDNADIKANTYSFLNNTPTSNYQYGNEDDFSDYTSGTESTTSSSSEEKDEDFYDIDSDEHDNSNVRRALVKDAKKRLMSSTELSALARENSNENMAGRVRFSLDDERFDKVEYELERYYKDFSDLDPKRHYAIRIFNTDDTFTTLSCTPGTTVEEMLPTLKKKFNITSQSNFQISLKVGKLSKILRPLSKPILVERKLLLLNGYRKSDPLHIMGIEDLSFVFKFLFHPVTPSHFTPEQEHKLLRSDFVHVDLRNMDLTTPPIIFYQHTSEIESLDVSNNANIFLPLEFIQSTIKLLSLRMVNVRASKFPANITEAYKLVSLELQRNFIKKVPSSISKLGNLTILNLQCNELDKLPNGFVQLKNLQLLDLSSNRFVHYPEVINSCTNLLQADLSYNKIQSLPESINQLVKLAKINLSHNKLTTITSLVSMKSLRTLNLRHNRITSMKTDASNLQNLFLTDNRISRFEDTLPKLRALEIQENPITSISFKEFYPMNMTSLSLNKAQLSSIPGELFTNLTRLEKLELNENNLSRLPPEISLLSKLIYLSVARNKLECFPPNFSQLTSLKSLDLHSNNIRDFYDGMEDIELNFLNISSNMFGTPSLEKPFYQNILNGAKLSKSLLFFIAADNQFDDDMWPFFNSFSNLQLLNLSYNNFKNASALKLQSLTELFLSGNKLATLSGDSFLRWSQLKTLMLNNNQLQTLPAELSHLSQLTTLDVGSNQLKYNISNYHYDWNWRNNKDLKYLNFSGNRRFEVRSYFDETLGADLSDMTELNNLKVLGLMDVTLNTTRVPDESSNFRLRTTASVINGMRYGVADTLGQRDHVSVRDVTFERFRGKDDECLLCLHDGKNQNAEYGHNISRIVRDIYDKILIRQLEKYGDNNDENIKKALRFSFLQLNKEVNGMLSSVDNGTNVENLTSADLLSGACSTIIYIKGKKMFTANIGDCMGVLSKYNGDYQILTKRHVPSKREEYERIRLSGGYVNNDRLDGVADVSRAVGFFDLLPHIHASPDISMVTLSKADEMLVVATHRLWDYMDVETACDIARENSTQPMLAAQEMKDHAIAYGCSEAITILCLALDKSTEGQRKFTVNKNSLMTRRTTFEDTTLRRLQPEISPPTGNLAVVFTDIKNSTLLWELFPNAMRTAIKTHNDIMRRQLRIFGGYEVKTEGDAFMVTFPTPIGALVWCLSVQLKLLDAAWPQEITSIQDGSLVTDEQGNKIYQGLSVRMGTHWGCPVPELDLVTQRMDYLGPVVNKAARVSGVADGGQITLSSDFISEFNKIMEYHKEVVNDKKSLKDVYGEEIIGEVLEKEIAMLENIGWVFFDHGEQKLKGLETKELVTIVYPKSLGSRHNFSSETEDSKSVDRDLLFKLRTLSNRLECVTSAVSGGTLEVEAHLEDNTYVTLDDRSRNAIMSAISDREVVSFLDHLVTRIESMVSLLLVRQRLTGLDVYYGSDPLHSPQSIFDIVDIVLKTYEEGENPH

SEQ ID NO: 219 - protein, 2040 aa, Exophiala dermatitidis NIH/UT8656
MAIFGSSPASNAGNRQLPTAHQQATSADIAPWASRPPNDADFAPWEQDPQAQMGGTRPFNQSYFNDVPMGREGQGLSMRPDTARTNISDYPDFDIDARRPSVASATTVSSTGSRGSAVNGRYHKSLKGFFGEDPMDSRQGSSSNLPDQEPQGSFTEKPPGQRSNSVQTQNTVEDRPKTPAPPPSSDVTPWAYQNFEDVSNFGSAPIRQEQQSEFLQSGASSTSSHRRGLLHRHTKSKEDPPKGLLPPTSVPKRPSTSREASTSNLGSFRNTPQTMTPMSSSTALNRNASPSPSSRKENPPQPEKRSLFSKLKSRHKEKQLQPPEPVKPIVEPARSPEESKKGRSQSTRSTETQAAENKRDRETSIASVDSASTIKPPDPSPKIDRTFTSSSKSGRFTRHGKHRGPSGQSEASEKARLGNQQAPMQAGVFSLDTNFDDLSDIIAQPQVPQISGDAGIWAGKAAATPASELSAPAWDAPDSWAVKGQEDEILDSLPEATDNGLPAIQEEDGISYFMRVFRTDGTFATLSMSINATVAEVLKSLAKKSVLHDSIDSYQLLMRKHQLSRQLGASERPVAMQKRLLQLAGYTERDHIEDVGREDNSYLIRFTFSHEKQTGYGSGLDNDPAFNKMQKFSHVDLSGKSLVTIPIILYTKASEIISINLSRNLALRVPKDFITACINLREIKYTGNEAWRLPASLASATRLTVLDVSNNRLEQLDHAELHRLMGLVSLKLANNRLSELPPPFAYFRQLRSLNLSSNNFTTFPEHICNLKSLVDLDISFNKLSSLPKISQLTTLERLWVTNNDLKGPFNESFASLTNLKEIDARFNGITSIDSVTQLPNLEQLLVGHNNITTFKGSFAKLRILVLDHCPVTSFELDQAVPTLTSLNIASAKLVEFKESMFDYMPNLQKLNLNKNHLSNMSTHIGRLSKLEYLSMAKNPLNIVPSSIGCLVELKFLNLRECNVKSLPPEIWYCRRLETLNLSSNVLETFPKQGAAPPPLDVKDLTPTTTPGLSTSPSFEELGKLEDFQARRPSQASAGMMSIGSSPSSGRKNSVASSIQPHRKPSTISRTNTEYSMSTATRKDSNMSQARLQNTFAGSLRFLYLADNRLDDDVFRELALLPELRVLNLSYNELDDVPQGVLRRWPQLSELYLSGNRLTSLPSDDLEESSNLKVLHLNANRFQVLPAELCNVHKLSTLDVGSNALKYNVSNWPYDWNWNRNTNLKYLNFSANRRLEIKPAHQNPTQFNAMDRNETTDLTSFNTLKYLRVLGLMDVTLLTNTIPDDNEDRRVRTSASLVGALTYGMADTLGKNEHLSTLDLLKPNFRGQDDEILIAIFDGQTMSSGGSRVAKYLHENFSGVFAGELKKLDNSKETSLDALRRAFLSMNKDMANFASSNFDTKEHRLANGHRGSTVANTLGPDDLSSGGVATVLYFKGQQLYVANVGDVDAILIQSNGQHRQLTQKHDPAEPAERERIREAGGYVSRQGKLNESLEVSRAFGYYSHMPAVIAAPHTLNCEVSESDELIVVATREFWDYVTVDVAVDAARAEKGDLMLAAQKLRDLAMGFGARDKIMVMVLGISDLRKRRDRRYHGTSLSMAREIGLDEGAIFPSSRKARRKGETLVGDSRLARLEEPEPPVGDVAICFTDIKNSTALWEILPVPMRSAIMMHNELMRRQLRIIGGYEVKTEGDAFMVSFPTVTSALLWAFSCQSHLLELPWPTEILETVHCQEKLDADRNVIYRGLSVRMGLHWGRPVCEQDPITRRMDYFGPMVNKASRVSAVADGGQISVSSDFINEIQRTLESYADDDRRDSTGSDETVNDDPLANQIRRELRQLSSQGFEVKDLGEKKLKGLENPEYLYLIYPHSLAGRLTIPPGAEKQVQLGDTGPVTNEDKGQPGSLGKDTQLKELQLDEVWKLWDIALRLEMLCSCLEAPERAAGLHKPELSLLTRMKERGGVQTDGFMMNLLEHQVTRVEACATTLQLRHMTRPFRKGVALVDQAMPIAEILNEVATLLAEARGAKEAFTPETEEETQSLATQSP

SEQ ID NO: 220 - protein, 1784 aa, Colletotrichum higginsianum
MYGSNRSRAQSPTPSGGYFSSRHGTVDGSISPGSQLQPQPPQHQQQHQQQQHQQQHHSKRNLLHRLRRNKDKDDGTSRLRDLPGSTRSLAAKPSRPEFTRPDLSPSTFPLAFSGTEPGPDQDPRLAAYNQRNQTQAQTFNNRFPFSKSKGRQQRPTESQDEQIGPTDRQPGGFGTVFHLDTNLSDMEGILTKPPPLTPMDHTFITNIVDPEKVEPPPVPAKPDVVPGPNGSWNAPDSWAVRRNTEDTTYQAPDIDDIGSPPRPEEKMTPYCIRIFRSDGTFATLSMALDASVTDVISQLIKKTYATDGLENYHIILKKHDLVRVLSVAERPLLMQKRLLQQIGYEERDRIEDVGREDNSYLCRFMFLSSRESDFHSVTNDLGLGRIQKFNHVDLSGRNLITIPISLYSKASEIISLNLSRNLSLDLPRDFIQSCQNLRDIKFNNNEARRLPPSLGKAAKLTYLDVSNNRVDQLDHAELHGLHGILKLNIANNRLKALPQYFGAYKALRNLNISSNFLDRFPLFLCDVESLVELDLSFNSISSLPDQIGKLRNLEKFVITNNRLSNSLPDSFSELSGLRELDIKYNAITSINIISLLPKLEILSADHNSISQFIGSFERIRSLKLNSNPITKFEIIEPVLTLKMLNLSHCQLASIDETFNMMLNLERLVLDKNYFVSLPQHIGNLGKLEHFSIANNNVAELPTSIGCLTELRVLDVRRNNIRKLPMELWWANKLETLNASSNILENFPKPASRQPRPAGEEAQTPAAVNKPNTMERIVQSPLEESLDASRRPSQNSSSTLLSVGPSPVPGSADRKSSVVSVYGKGGRKTSVVSRSTSQGTVPPMPSSATARKDSSLSSRLYSTFAGSLRNLHLAENKLDDEVFDQITMLNELRVLNLSWNYINDMPQRSIKSWPQMVELYLSGNELTTLPADDLEDGSLLQVLHINGNKFTNLPADISRAKKLAVFDCGSNYLKYNICNVPYDWNWNLNPNLRFLNLSGNKRLEIKQTITGPTIPNRESLADFNRLLNLRVIGLMDVTLTQPTIPDQSEDRRVRTSGSSAGNLPYGMADTLGKNEHLSTIDLVVPRYNSAESETLLGLFDGQALSSGGSKIAKYLHENFGHIFSMELKALKTRLNETPVDALRRAFLSLNKDLVTIAIQHTEERSQKTHRGSTTPVVLSKEDLNSGGVATVVYLQNQELYVANVGDAQAMLIQSDGSHKILTRKHDPAEPSERQRIREAGGWVSRNGRLNDLLEVSRAFGYVDLMPAVQAAPYVSNLTIREQDDIILIATREFWEYLDPALVVDFSRQERGDLMRAAQKLRDLAIAYGATNKIMVMMISVSDLKRRSERSRLHRGQSMSLYPSGVPDELQPLRRGKRNKGDVLDSTLQRLEAEIPAPTGNVSIAFTDIKNSTTLWEMYPAAMRSAIKLHNEVMRRQLRRIGGYEVKTEGDAFMVSFPTATSALLWCFAVQMSLLDVNWPSEVLNSVSCQPLYDKDNALIFKGLSVRMGIHYGEAVSEMDPVTRRMDYFGPMVNKASRISSVADGGQITVSSDFISEIQRCLENYQDTDRNGSTGSEDTFDDDQGFASSIRKDLRSLSSQGFEVKEMGEKKLKGLENPEVVYSLYPHALAGRIEHHQQHEQRTEVDKPAILQAGSELAFDTESIWALWRVSLRLEMLCSSLENVSGQGLQPPETELLERMKHRGGEVTERFLLNFMEHQVSRIETCVTSLSLRHIAIGNAPLEQLEDMRGPMSDILDQVAKQMAELARYKALYGELDEPEDGSDTE

SEQ ID NO: 221 - protein, 1766 aa, Rhizopus oryzae RA 99-880
MHSTSWEQSNNGGKRKDTQIEALLPNNNQHSDSFFNRVFGHHSPESSRAGSPIPPPLNQQTLKSETAVEKSSSYQYYNSSTDTTPLSVTVPYLSTATILTSDLENRMQRRRSFNGQTSDTNSLKPKPVPTASVSARVSPIPSGLEAQNSTVPYPRGGTHIGANEDCDSLVRRSNSIDHGQFRLEGKDVFLALSGVFISIVLYHRASTKETAFLQTRYISDLSSASDVQKHPYQKQKDERKKLAMDQNFETMDGIFKSDLNKTVSPNPQLTADNLSLGFDFESWAPPDSWGVQPASIAANLALDDDQAEFEDFHVQKKWDIPKRNANIKIYRPDQTYNTLHIPLNTTTYEILKKLAKRVLDLTERPVQIQKMLQEQMGYTDDDTIDDISYLIRFQLMPNVSQPLQQDDKEIGEYVDLQSRSLATIPIYLYKHAPSLLSLDVSVNMHMEIPLDFIQTCTNLKQLCIANNEYNAMPSSIQHIASLKHLNISGNRLRDLDHEGLEKLSELRTLRIINNRLETIPSYFASSFQYLTSLFISNNSFTKFPLVVCEINSLAYLDISFNKIQSFPDEIGQLANLVGLFAIANRITGRLPASFINLTKLQELDIRQNLITDLDVVSHLPKLEILLVNYNSSSIINFQIKNLKELKMYKNHLTQFNLTSSSGGKSLTELNLSNCKLSSLPEGLFENTLGLKRLVLDSNTLSTLPSSIGALQKLTKLSIQNNYLEVLPSEIGKLGKLKGIDAQKNNLKALPKEIWLCASLSTLNCSSNLLDSFPEPYSAITSPPVPNKVSQSDSASVINSMDNILNMMPTSSLNADQGSIKHLHTSSKNATMADIMSHAQSESLQSYCFNPSSSFGSLRNHPPPLSLSLQHLLLGDNRLTDDIWAPLSLFSELRTLNLSFNDLYEIPAGGLRYQLYELYLSGNQFTSLPADDIEKLQFLRVLAVNGNKLQTLPAEIGKLRKLVVLDVGNNVLKYNIANWPYDWNWNWNLSLKYLNLSGNKRLEIQKTHPDPFNPKDKDLSDFSALTKLRMLGLMDITILGVSIPEEFHDRRVRTSPSEVNSMSYGIADWLGPSDHLSTWDLVMPRFRSKEDECIFALFDGSKHPKGGCRLTKQLNDKITTHFTKELATIKSEDTIVSAIRRAFLSLEQSLGSLSQIDKESGASAVVCYISGTKLYVANVGDVLAVISRNNGQAFEITQKHIPLNPSEVSRIRAAGGYVSNSGLLKNELKVSRSFGHFHLIPVVNCNPFVSTIDLSENDEFVIMASRGLWDKMTYQTAVDITRTEKDDLMAAAQKLRDFAITYGANDNLMVMVIGVGDMFDKRDKRFRKNNICTGRSGTDGVAEDGMLMKSNKRRGKEEVPGDSTLARLEREVAPPVSQVALVFTDIKSSTQFWETQPENMRAAIKIHDAIMRRTLRSVGGYEVKTEGDAFMVCFKNITAALLWCFTVQLQLLKADWPAGILNAEEGREIEKDGVIIYKGLSVRMGIHWGTPVSERNPITQRMDYFGPVVNKASRICNAADGGQICVSSDVIAALRNFPSMFSDDAELDENLDKDEGSFPVSRDLLQLKKLGFHVVELGERRLKGLETPETLSLVYSKQLLGRIDVGESEMVASLGQPPLDASLLSKPSKSDTMATVSAIPALDSSSPPPIDYIAAQSITRKTLRTIDPSLVCAMSNLAIRLERLTSGHVLSQTTEGSSVLNQHIREEATDEELMVMMENCNATSALYLQRMGRFANVLEKLSEAIEADAMHIMKALQMYAELTTNKL

SEQ ID NO: 222 - protein, 1719 aa, Rhizopus oryzae RA 99-880
MNIQYPRHMHTPSWEQSNNNSGKRKETQTVSNSFPNNSNNNPQHADSFFNRVFGHHSSESSRAGSPVPPQPSTGPSSSRHGRNSSTGAISISVTTPYHSTTSHHIKEESNMPRRRSLDGQTTVTKNPKPKPTASASTRASPIPSVRGVRANPIPFPRGGRQIGTNDDNVTVRRSNSIERSGLKLEDNNATSSSAASIMTNLTTGTGSSATLTNTIVPAQRKRSNDADNKNIPDVSSAYDIQRNYYLQQKDERKRSESRRGRIDYEKEHLLHLKLDQNFDTMDGIVNPEYYKTFSPAPQLAMDNGFDFESWAPPDSWGVQPASIAANLALDEDQTDFEDYQISVQEKWDIPKKNANMKKYNLVMKRYNNERILGFSERPVQIQKMLQEQMGYTDDDKIDDISYLIRFQLMPIITQPLPLEDKEFGQHVDLQSRSLATIPIYLYKYAYSIVSLDISKNLHIEVPLDFIQMCTGLKQLWLANNEYPVLPPSTQCLASLEHLNISGNRLRDLDHAKLNKLSQLRTLRAINNRLESIPDSFATCFQHLTSLFISNNSFTKFPLVVCEITSLAYLDISFNKIQSFPDEIGQLTNLIGLFAIANRITGGLPPTLMNLTKLRELDIRQNLITDLDVVPHLSKLEILLVDYNSTSIINFEIKNLKQLKMYKNHLTQFNLTSATGGHCLTELNLSNCKLSSLPENLFNNTLGLERLVLDSNTLSMLPSSIGALQKLVNLSIQNNYLENLPGEIGKLSELKTLDAQKNNLKSLPKEIWLCASLQTLNCSSNLLDSFPEPFSPANAPPKTILHPEDNSKGGNSVLNMLPTTSLNAGQGSIKRLDSSSSVKTTPQTPLESSNSFNFNPPSFFESPRNHPPPLSLSLQFLFLGDNRLTDDIWPPLSLFSELRTLNLSFNDLYEVPPGGLCHKLIYELYLSGNHLTSLPADDIEKLQYLRVLAVNGNKLQTLPAEIGKLRKLLVLDVGNNVLKYNIANWPYDWNCALTRLRMLGLMDITILGVSIPEEFHDRRVRTSPSEVNSMSYGVADWLGPSDHLSTWDLVMPRFRSKEDECIFALFDGSKHPIAGCQLTKKLNDMLTTHFTKELSRVMSEDTIVSAVRRTFLSLEQSLGTSPMIDKDSGASAVMCYVSGTKLYVANVGDSLAVISRNNGQASEITQKHIPLNPSEVSRIRAAGGHVSNSGLLNNELNVSRSFGHFDLVPVVNCNPFVSTIDLSENDEFVIMATRGLWDKMTYQTAVDIARTEKDDLMAAAQKLRDFAITYGANDNLMVMVIGVGDLFDKREKRLRKNNLGAGRAGPDGVTEDGLLVKSSKRRGKEEIPGDSTLARLEREVAPPVSQLALVFTDIKSSTQFWETQPENMRAAIKIHDAIMRRTLRSAGGYEVKTEGDAFMVCFKNITAALLWCFTVQLQLLEADWPAGIIDTEEGREIEKDGVMIYKGLSVRMGIHWGTPVSERNPITQRMDYFGPVVNKASRICNAADGGQICVSSDVIAALRNFPSMFNEDAEFSESLDGDEGSFPVSRDLLQLKKLGFHVVELGERRLKGLETPETLSLVYSKQLLGRIEIDKSQMMAPAVQPSLETSLSPESSNDSSNVPETSALNDVSAGYLVAKTDVMPRKTLRTIDPNLVCAMNNLAIRLERLTSGHVLSQTMAGSSILGRYTYENSLDGSNVDSATHLSLGSMLDRHLREEATDEELMVMMENCVTRVEVTKE

SEQ ID NO: 223 - protein, 1328 aa, Dekkera bruxellensis AWRI1499
  misc_feature (18)..(18): Xaa can be any naturally occurring amino acid
  misc_feature (53)..(53): Xaa can be any naturally occurring amino acid
  misc_feature (95)..(95): Xaa can be any naturally occurring amino acid
  misc_feature (105)..(105): Xaa can be any naturally occurring amino acid
  misc_feature (107)..(107): Xaa can be any naturally occurring amino acid
  misc_feature (344)..(344): Xaa can be any naturally occurring amino acid
  misc_feature (459)..(459): Xaa can be any naturally occurring amino acid
  misc_feature (523)..(523): Xaa can be any naturally occurring amino acid
  misc_feature (546)..(546): Xaa can be any naturally occurring amino acid
  misc_feature (549)..(549): Xaa can be any naturally occurring amino acid
  misc_feature (601)..(601): Xaa can be any naturally occurring amino acid
  misc_feature (612)..(612): Xaa can be any naturally occurring amino acid
  misc_feature (619)..(619): Xaa can be any naturally occurring amino acid
  misc_feature (629)..(629): Xaa can be any naturally occurring amino acid
  misc_feature (645)..(645): Xaa can be any naturally occurring amino acid
  misc_feature (901)..(901): Xaa can be any naturally occurring amino acid
  misc_feature (946)..(946): Xaa can be any naturally occurring amino acid
  misc_feature (976)..(976): Xaa can be any naturally occurring amino acid
  misc_feature (1307)..(1307): Xaa can be any naturally occurring amino acid
  misc_feature (1314)..(1314): Xaa can be any naturally occurring amino acid
MMKWHRLQNMSATPISRXSSVNTVSYEKTARKDSTSGWLAPESWKVKTDRQLXRDQDEDKSAAGDDLSDDMDSSSNNFSFYTETTTSDDSRKNTXKRDSNADNTXKXHKVHHSNELRGASRSSVRIFKGEKSSVLPCTLETTCKDILDALRRKRFLRSEEDHIIVLKCGGLTRSLSYDERLLRIQRNMLFLYGYTERDNLDYIERTDLSFLFKFIVQERGVELISEDKRTMINPQNVVLRNWNIQDIPNFLYAEPIVSLDVSQNPSFRFTKEFMHDCRNMLTLKFTRSGHPSFPAAIAYAPRLTTLNLEVNYIRIIPPEISNLDTLTTLNLACNRISRLPDSFXKLKSLASLNLSSNRLKRIPDQVLAIKGLRRLDLSYNAITKISDKLTHLKDLVVLQIAGNSLTEELPAFFEIFQNLIKVDVRFNKLSSIDSLKNSPKLEVIRATGNNISVFRSSTXSLFEVEMNLNPLTYVYFESEMPNLKVVDLSKGKLTSCSFVAMLTGVEKLTLDINHLTTLPEEIXNMKKLVHLSVFKNNLNYLPASIXKLXNLEYLDLHLNNLNGLTDSLWLLPSLKYLNVSSNLLEGFPPIPSIADIDGKEXSSITTEVETIXNDEASDXKLDALSDTLXYLSMNDNNISDSVVHXIGKFKNLEYLNLSYNELYDIPPGPLANLHKLKALYLSGNFLSTLPIDDFDSFKDLTILHLNGNKFHSLPAELSKLKNLTALDVGSNNLKYNISNIPYDWNWCYNKKLQFLNFSGNKRLEIKPQFNRGETDEHLDSFIGLHDLHMLGLMDVTITTDAVPDQTVNVRVRSTSSQLGKFGYGISDTLGSREVLTTRDVVLEKFRGHSDEMLLTLYDAKNCSQTHGDKISKIIQETFGIHFSKELESLGKVIIPGSTPKXIEDCLRGAFLKMNSEMNILINRDTSSTFSSAAAHRTQTTDKLSLXEDGYSGCCAVVVYIKGDMIYLANLGDTMGXLTKSNGEYQVVTTKHEPYAPKEYDRIRQSGGYVTTDGYLDGVSEVSRAVGYFKLIPHITASPSIHKFKLTANEEMIAIATSDVWKKIPFDLAADIIRQEKSNPEVAAEKLRDFAISYGVSDKVTAVVLSLRQFTTKAKHHERGTLPEDSILRKLDEEIEPPVGEVAMVFTDIKNSTLLWDTFPVAMRSAIKVHNSIMRRQMRIIGGYEVKTEGDAFMVSFPTPTSALLWCFSVQQLLVNTDDWPAEILASDQGCEIKDDHQNVIFRGLSVRMGIHWGMPVCERDIVTRRMDYFGPMVNRASRVSAVADGGQITLSNDFYQEFQKLQKQHKXLKEKKLXITDVYTSKAMGPDH

SEQ ID NO: 224 - protein, 2143 aa, Colletotrichum lagenarium
MSIVYNSIVFCLPSSSTFSTFSVVTTSPTFASAPRGALSPASTTSNVSPFRDHRLSDFANYRRDLAVLETSSGRLPTIQQQPPTATPSSTSQVAPWMSPSNGGATAHAHPHAHPHTSQSQLHTTFFNDSSDNLSVSSQLSPGFRPPTNRIAPQSSGSQDSPDGAYFGDERRPSLASITTLSSQGSKASMRRGGLQKLQGFFGEEFPGRDGSESSLHSSSGKDRSRSYSHSRPTRDRNYSNATDHARDREGSPSSSRPRTPVPAPEVVPFLYQEADDIARYGEAPVRDILSGPDRERYMNNENPNNPQNPPKTSSSGRSGHSIVHLPGHHHRHNKSIDDGKALRPTVSREDSQASLQVQQHPRERGGSAATVMYGSNRSRAQSPTPSGGYFSSKHNPSVDGSTSPGGQSHHHSHTKRGILHRFKRNRDKDDAASKLREMPGSTRSLASKPSHSNFARPEPAPNTFPLNYADTEPRSNQDPRLAAYNQRSHQPFNNKFPFSSKGKARHQQRTDVPEEHIGPTDRQGGNVFVLDTNLNDMEGILTKPQPLTPMDSAFIASVEPDKDAPPVPAKPDAQNGINGNGAWNAPDSWAVRRGTEDTTYQAPDMDDVGSPPRPEEKNLAYCIRIFKSDGTFATVSMLLDSTVTDVVSQLVKKSYTGDGMENYHIILKKHSLVRVLAAPERPLLIQKKLLEQLGYDKRDKIEDIGREDNSYICRFMFLSSRESDFHSVTNDLGLGRIQKFNHVDLSGRNLITIPISLYSKAAEIITLNLSRNLSLDLPRDFIQSCQNLRDIKFNNNEARRLPPSLGNAAKLTYLDVSNNRLEQLEHAELHGLQGILKLNVANNLLKTLPQYFGAYKALRNLNISSNFLDHFPLFLCDVGSLVDLDISFNNIKSLPDEIGKLQNLEKFVITNNSLNNSLPDTIRGLSGLRELDIKYNCISNIDSISRLPKLETLSAEHNSISQFVGTFDCVRNLKLNSNPITKFELSAPVPSLKMLNLSACQLASIGETFNNMLNLERLVLDKNYFVSLPAQIGNLSKLEHFSIANNNVAELPTSIGCLTELRVLDVRRNNIRKLPMELWWANKLETLNASSNILENFPKPASRQPRPAGEEVQTPGAVNKANPMNVLPQAMDDGLDSRRPSQNSSSTLLSVGPSPAPGADRKGSVVSVYGKGGRKTSVVSRSTSQGTVATMTPPSTRKDSTLSSRLNTTFAGSLRNLYLAENKLDDEVFDQITMLNELRVLNLSWNYINDMPQRSIKSWPQMVELYLSGNELTTLPADDLEDASLLQVLHINGNKFTNLPADISRAKKLAVLDCGSNSLKYNISNVPYDWNWNLNPNLRYLNLSGNKRLEIKQTSTGPATSNREAYHEFNRLSNLRVLGLMDVTLISPTIPDQSEDRRVRTSGSLAGHLPYGMADTMGKNEHLSTIDLVVPRFNSSDTETLLGLFDGQALSSGGSKVAKYLHENFGFHLAQELKALKTRDNETPADALRRAFLSLNKDLVTVAVQHTTDDRSERSAQKTHRLPSVASPVILSREDLNSGGVATVVYLSHTELYVANVGDAQAIIIATDGTHKVLTKKHDPAEPSERLRIRDAGGWVSRNGRLNDLLEVSRAFGYVDLMPAVQAAPNVSHRTINEHDDIIIIATKEFWEYLDPALVVDFARQERTDLMRASQKLRDLAIAYGATNKIMVMMISVADLKRRVERSRLHRGQSMSLYPSGVPDDLQQLPRRGKRNKGDVDVLDSNLQRLEAEIPAPTGNVSIAFTDIKNSTTLWEMYPAAMRSAIKLHNEVMRRQLRRIGGYEVKTEGDAFMVSFPTATSALLWCFAVQTSLLEVNWPAEVLNSVSCQPVFDKDNALIFKGLSVRMGIHYGEAVSEMDPVTRRMDYFGPMVNKASRISSVADGGQITVSSDFISEIQRCLETYQDTDRSGSTGSEDTFDDDEGFAFTIRKDLRSLSSQGFEVKEMGEKKLKGLENPEVVYSLYPHSLAGRIEAHQQPEARIEVDKPAMLQAGSELAFDTESIWALWRVSLRLEMLCSSLENVSGRGLQPPETELLERMKHRGGEVTERFLLNFMEHQVSRIETCVTTLSLRHIVMGKPPLNQLDDLRMPITSILDQVGEQMAELARYKALYGELSESDQGSDTVQE

SEQ ID NO: 225 - protein, 2387 aa, Tetrapisispora blattae CBS 6284
MNINSDTCTTQQKDGKTKRRRSLQLNRTMSALSMTSFTALSSSNNHNINNSNVTSNASSFSRPHSGKPNRSLISSSSTPRVLRTMSNSLQEVSSNLSTKRQPTQLQSSATASNADIDPPTTKSNQKKKQKNEKVTRKQSFAGRMLRKLSSNTSSPSQSDAHSHQQHAHTRPHTHHQFKTNTPSNSSIYSGKSKLNKKASIGTLNTTSNASNVTGSPGTTSKISRRSSTNSANVHDMENSTTTSLFRKVSNVLGHGSSINSKDNKDSTILSPNSNPFNSPSNSRRSSQVSNVATNNICTIDANTNASSRLQNQVLFNVNEDIPTKDNNDNHIKGNNTKATTATTTTSNNNVPIGEKEVTSGGKPKKNKILKNLKKDNTDNGNITLVLNNNKKIENVEEDEEDKTESERSSSFPPLVNPNAFKLDTNLEDVSDITNINKTGSIPHDLMNTNTKSSKSIGTDTLLLSQKRSRSLADVVTYSNNQDNLSFLSNMDSMRELDINGDPEESFIDEEDDDDFKNEDYDSEAESIKDNDSDMNIELESQNPKKQSRKISGKNFKEEKNNESFSDLSTSDSSDNSDPNLDRKQRVSKISKLHSSKKPKQWVAPESWDVELTALENTRQRRSNSNRSRSNSANSNRHRRRHHHHHHHHHYQDTSEAKIANNANLASNNNDKEDPSIPTSSTNIKNNESIIANKLNTNLNQGKASMLNSYNDTTSISPTDKSEIIQSNNSKVLSHLHNRLLMTPSTINTSQNSNHIVYDNDQQGNTVLASSKKSTSLNSSTDNNNTVFYYNDEDESYSPTTTSETSSGSLSDSSSTWSNEYRHHSRGKTVDSNGNHLNNEELNDATEYFTTSHSSYRDIRGGTDMAYGFDEDVVDTSHYTPSVAKPADGGSIGGGSLGAHSSVGSGSYSRQKHDNSNTTDDDDKDIYSMDRHSFGNYVIRDKIRSSSGSKSTSAVDNFDEDCLNPAHPHNSLNFFFSKSKNVSSHSLHKPTMSSSDQSKYSNILKTDSENTVIFTKDDEQHDQAEYELEKYYKDFSDLDPKRNYAIRIFNTDDTFTTLSCTPGTTVQDMIPTLRKKFNTTQQGTFQISLKVGKLSKILKPQSKPIIIERKLLLLNGYKKTDPLHIMGIEDLSFVFKFLFHPVAPSHLTAQQEQKLLRGDFIHVDLRSMGLTTPPIIFYQHTSEIESLDVSNNANIFLPSEFIESGINLSSLRMVNIRASRFPTNVTDAYKLISLELQRNFIKKVPNSISKLTNLTILNMQCNSLSKLPKGFAKLKNLQLLDLSSNNFVEYPIVINHCSSLLQFDLSYNKIQYLPPNINLLNKIAKINLSHNKLLEITDLSSLKNLRTLNLRHNRITTVKTSAINLQNLFLTDNRISTFDDALPKLRALELQENPITSITYKDFFPINMTNLSLKKAKLSSIPGELFLKLHRLQKLELSENNLTQLPKEISCLNKLVYLSVARNKLEGLPTEFSKLKNLKSLDLHSNNIRNFILGTEDIELTYLNISSNAFGEFALDGTFFQTITNQSRMAKSLLFFIAADNQFDDRIWPLFNCFENLNVLNLSYNNFTDISNLKIQNLTELFFSGNKLTTLPGDTVLRWLSLKVLMLNGNHLLSLPAELSKLCQLTVFDIGSNQLKYNISNYHYDWNWRDNKELRYLNFSANRRFEIRSTASRDINADLSDFSVLPNLKVLGLMDVTLNTSKVPDEGYNFRLRTTGSVINGMMYGVADSLGQRNYVSSRDVTFERFRGKEDECLLCLHDGKNQTSDIGHNISRIVRDIYDKILRRQLEKYGEDDEGVKKALRFSFLQLNKEINIMLYSVDNGTRVENLTSADLLSGACSTIIYIKGNKLFTANIGDCMAILSKNNGDYEKLTTLHVPYKTEEYERIRISGGYVNNDKLDGSVDVSRAVGFFDLLPHIHASPDISMVTLTKSDQMLVIATHKLWEYVNYETACDIAREKSSDPMLAAEELKDHAIAYGCSDNITILCLALNKSANQQNRFVVNKNSLMTRRTTFEDATLRRLQAEIAPPTGNLAVVFTDIKNSTVLWELFPNAMRTAIKTHNDIMRRQLRIFGGYEVKTEGDAFMVTFPTPISGLVWCLNVQLKLLDAQWPEEITSIQDGCLITDKNGVKIYQGLSVRMGIHWGCPVPELDLVTQRMDYLGPVVNKAARVSGIADGGQISMSSDYVSEFKKIVGYHERITKNKERLNEVYGEEIIGEVLEKEVTMLESIGWVFFEHGEQKLKGLETKEFITIAYPKTLASRHEYTSDVEEGDVNTDALFRLRSASNKLQVILSAVSGDYLELDTYSQGLHGFIDLTENSQDTILKDLNEKELMAFLEHLVSRIESTVAILQLRQRISSGLNIYASSERVSSTQTSIFEIVDMLLENLGK

SEQ ID NO: 226 - protein, 2507 aa, Tetrapisispora blattae CBS 6284
MVGSIDPRKPKDMNYRQESTSHLNTPSPASFITANLDTDDSSNSNVNIEDSSVSAVAGPTITHLSTLATDSTDYSGVFDSPEIYLQPTKNVTEDHTKRITVPRVHEQLVRQRACSLGSKVANIDISKDVDAWKKIASDRIASDRIDSPSEFVTNHLSASSYTISQPHHSCSNPHLNFQDASDITSHCLPKRLNDRRDQGETPDKTSPAVPENKTNSHRNLHSPLHSPSHSTRNSIDQQQQQQQQHHHHQYSRASKDTNVTHQSESHTTSLLSRHKIVPPSKLLTSMQPPKVIQQKSSNTMQTSTSYKSDSASSRSNRHSSLSSTNSTGGSTSHKIHEVLEKKIDSSTTLNSAGKILESPFSLVKKLGTSVMHPPSSPHHQHSSEPQHLSESQPYYHHHHHHHSHDDSTKFLTATAHHETSFTSMSNISPKTSLEREETVSRSSLHREEVSPRSSLHKDSRRSSLHKEKVNSRKSSLHKEKTESRRSSMHKDKTSTPKSSLHEAVSSPSSHSKDLPHTNKDEILQSKPHRSISRETTISPSNSFTDNRESTIVTSSTHQGNTIDTRRSSLDTRRNSINIHRNSIDSTLLDAKTPSPKSRRPSYVSENSINTNPSIHYCVEETNYPNDSTNEYILTPSNYPILDTLTCSTPEGHSLISSPTSVKKISSDTSYFSSVPSDSLEIKEHSHLNQVSEETSINRGATSNIEHLTDQNSHDTNMHNNDIGSESSQDDKDPILTSNNVTKSTHGLHGMRRRSYERKRDSFKTLAEEPPISNLQHNRKVSFSLSNTDEENSLQQAHKNYAKNHLLETTMDKPDSYNNTDRNVQIIEPSKQESSKYSHGHKTSDHDRHANPHFRKTQSITNAKSLVEYEKKKVDQFLAHSHRTSSNESKDHELLTDKRRHSLAPIFNNTISDAIQKTTSFVINNPVHARLSDHQSTMNNGLFHHENSSKNYHDKSSEDDSLIHFRFNISRHDSDSSYATANNDSESFVDSIDTTSSQDQHNANFKGLVNILPKSRIKSIVNRETSTSRLPDIENASHLSTHSSRVKTDSIHSSFSGNSSEMNDKFYESQQNLFSGHYTNFTPENKKLIENGKLPKDDSLSPNASPVLGPTNQKYFDSDLMLEELSDDEFFSQDEDDSQIDQKTDNAEFAYENYFRDVSDVDPKKRYAIRIFKSEQVYTTISCYPTITVQDMIPIIKSKFRLESDEKFQLSLRVAKISKILKPTAKPILIERKLLLLNGFRKTDPLNILGMEDMSFVFRFEFHPALLSYRISEKERRMLRSDFTQVNLRTLNLITPPIIFFEHCPEIETIDVSNNPNILLPSSFVKAAIKLSSLRMVNIRASHFPPNITEARKLVSLELQRNFIKTVPESIKNFTTLTILNLQCNKLENLPDTFSSLQTLQLLDLSSNRFIDYPSVINDCRNLLQLDLSYNKIHSIPQSINQLTKLVKLNLRNNKIHEVGDLSKLNNLRTINLRNNRIVNVESNAPHVQNIVLIGNRISFFKDTLPNLKSLELQENPITSIAYKDYYTNNMTSLSLAKAKLASVPGELFTKLTNLEKLDLSDNNLNRLPQEISSLTRLVYLSASRNKLDGLPVGFSNLTSLKSLDLHSNNIRNFVLGIEQIELNYINISSNAFGDLVLENPFFQETCGKRTKLSESLMFFIAADNQFDDRVWDMINTFTNLKVLNLSYNNFTDISYLRLENLTDFYFSGNSTTNIPGEIVLKWKSLKTLMLNGNLLTSLPSEVSELSELNVIDIGSNKLKYNISNFRYDWNWRHNKQLKYLNFSGNTKFEIKSWKNPETHKDLSDLTCLPKLRILGLMDTTLNTNKVPDDSSNFRVRTTASRINELGYGVADTLGHNNSVCTRDVIFSRFRGKDNEILICMHDSKGQGNATENNVSSIVKNIYDKILIHELEKCKDDDDGIQKALRLSFLLLNKQINVMLNSVDQGDKVENLTSVDVLSGACSTVIYIKGERMFTANIGDCMAILSKNNGEYKQLTTLHVPYKRDEYERIRISGGYVKDNRLDASVDVSRAVGFFDLLPHIHASPDISVHKISSVDDMVIIATKQLWDYVDYQTVCDIAREKNGNPLVAAEEMKDLAIAYGCSENLTIMCLNLKKDVERCFKHEGRSSVNIRKTIVEDAALRRLQPEISPPTGDVAVIFTDIKSSTFLWELFPNAMRTAIKTHNDIMRRQLRIYGGYEVKTEGDAFMVTFPTLLSGFIWCLSVQLKLLDAQWPDEITSINNGRMIIDKNGVKIYEGLSVRMGIHWGRPVPELDLVTQRTDYLGPVVNKAARVSGVADGGQITLSSDFVSEFNKILERHLKVVIKGFEISKEHDTIDNSLKEEKEIEILENIGWSFFDYGEKQLKGLENKEFITIAYPRKLATRHEYDMAAEKNEKIDMTLLVRLHVLANKLESIISAVSGGMIDIQERVNKTGPSEFDQRIQSAILNTVGEQDITSFFDRVVTRIEASTVLLQLRQYNSKGLEICSTNSLSCPIETKIFDIVDKLLEN

SEQ ID NO: 227 - protein, 2000 aa, Wallemia sebi CBS 633.66
MPPDTPPLNKVLSQNKSTPDLSERSSLDHKRASGEHKRKGWKHLLKSKPSTTSVHPNDRPDTSAGTSNESPALSRAASKADLTKESQPFATLPDGLSSSKQQRKPQSSQGKSTEKRPEVAPGDPGFVLDTDLTHMEGILAGHKDQPKRSKRHGSSSTAGNSSASSVKNTTSSGSSSRAQRNGRRSEANQPPMTIPTPAFLTGQFDLEPLPRSKRPRAQKSTYSTSPRTMEPPQLAPSLSMSPPSPVKSNTRKGSSERGDSKFPANSKWRINPPPSDYDIPKRLGGKRSGPPSPRQPDHVQLGGIKTSISQTQSPPTLATDNNVTSSGWQAPESWGIVQEPANHNEEYESETSEENEGDGYYDDDDNHQRRVSNYFDFNPKEDNWNGAFGEAATWGSPAFQRTSADQNSGVRPIKLKALEHNDPSSTEVNEYVDESRKNSDTGHYSTRSRQESNASGGQIQHLTAEQSEPAEMGEDIRKASLRRVSSAKRQGSPGMQRPSTAGSASQHGSRGPNGNYCIRIYKSDGSYLTFSSGLNTSVNELSHMIAKKLRVQPAMYQLYIREKLKERAMGSSEKPLLLQRRRLEQLGFTENDHLDELGKEDLSFICRFIYRIATVTYYEAEDIGSFGSFEYIDLQGRNLQTVPIFLYRHAHSMIYLNLSKNPLTDLPSDFIQLCTSLRELKLSMVSMKRLWPSVRLYCRSLTRLDMSCNRMPELDHIDFKCLPELHSLKVQNNRLTQLPESLAELKHLKYVNISNNKFDVFPQVVCKLKGLQDLDASFNTFQTLPEEISELKQIHRAVFVGNQLAVLPKSAAQLTSLRELDIRRNALTNISVVCDLPNLEVLLADFNHIGVLDVKIGPNANRFKAPNNPLTSFSLSTVNNNPAHITRLDLSNAKLAMISDDAFRYLPNLSHLSLDYNQFTTLPGAIGELSKLSILSCTNNLLSALPESISDLSNLRTLSLHNNNLKSIPTSIWQCKSLEVLNVSSNLLDDFPDPPFHHDSNSAPNATIAALATNAMSHQSSNPALGMRGGSTSSAISSEADRKTSASSANPQIGGSGTPQNRPALPLASKLQKLLIADNRVTDEVFDPISLLTELRVLNLSFNEIDEIPPHRLGKNSGLQELYLSGNNLRNLPSEDLERLIALRILHVNSNKIQVLPAELGKIAKLHVLDVGSNVLKYNIANWGYDWNWNWNLDLRYLNFSGNKRLEIREVKDYDRHSNAPGTLNLAEFSNLKELRVLGLMDVTLRVPSLPDESENRRVRTSFSNINNMAYGIADSIGNLENLSMSDFVVPRFRGKENECLFGFFDGKVSTSANGCHLSKYLHDSFEPQLNKELSRLGPGDDIPDALRRAFLRLNKKFFDTTLSSLVGVRRKTSNYSDVVPLSNLLNKSSSKSDSRKTSQVSANSVMAVVSTPTGTAKDAPEMGMFEVKSGAAAIVVYIVDKTMHVANAGDSLAVISRSGSPRVVSTKHEPLARPETARIRAAEGWVTPGGKVNDELDVSKSLGFYHLQPAVNARPAVHTITLTDMDEFVIVANKSLWDYISYQTAVDIARTTRDDVMTAAQKLRDFAIAYGAQGNLMVMVVSVADIFRPKHLPSSLEGNEDDYYGGLRRTGQRRRGDEAVVGDRTLARLDREVSPPVGHVTLVFTDIRNSTILWESNRGMQSAMRIHNHLLRRHLRTIGGYEVKTEGDAFMVSFQTVTSALLWCFTVQLQLLSQDWPKEILETDEGRPLLDANGNSIARGLSVRMGIHVGYPVCEADPVTQRMDYWGPVVNRASRVAAAAEGGQIMASGDVVSELQHFFSLDPNSPESETGMSNKIKSEVASLRRIGFGVSTVGERRLKGLEVPEHLSLLYPIQLRGRLQLDKNIASTTGQHEPSTSVFESTPPILHADELRRLAKLVVKIESLAGGKIQKEPTEMPEKDEDEKVESEIFAVVPANLLAPAIPDGASDGEMISILEALVSRMNNAINTMDFNRVRLALQQGRDKDEVIEQLLKITGLYT

SEQ ID NO: 228 - protein, 2525 aa, Ustilago hordei
MFSTMQSSLRPVASSPEQQQHRSNYSDFDLALERHNSHESATSSNFTHRADPPAQSSRHRGLSSLSFHSSQPDVNATPSPSSSRVANSPNYSRPRFEHAHTQPSTPSHSHNSPQSYFSADMHSHSFSGSTHGISSPFDEDELRQIMSRRPDAGTAPSLDGDVGKGVKSANHQDISPWLFQNDNGASTSTAVPAAASTCRSSNPSTTLSNRTASSSSASPAMPSRSIRTRPRRGTGTTQYSVNDGGIFADMPGLTASRSQYSLRPQTPPSASTSTSTLNGSKDTHPSAAKKSRNPFGFLKKKTSTHPNTSSSNPIRHEPPVSSLSSRYESNAANMNPMRPPAWLDNNRPLASTTSPSSASLRSHYHQPPAAQSTPWQNPLNARIDSLPPAVSLGDELELETQAKKERRRIKGVRHHLGKSSERSKTADDADSARDLSFPQQSRSLEQQVELSLDMNFDQLEDFVDTNAARQRLQASVTDGIATSPSDHRSPSGSDSGLYRSPSPSHASLADRQTSVTSTAESSSQLSDASLAQSGSIRTSNRNNASTSTGTSTSTILSDRRPSQINMPRNSVPRVSLAEMQNYQSLRKMSSNLHDMPESDSYNPSASSLPVRRGSAAANFASSDSSQHGVVGSSDAALIGHRKDSVVSAGSLRSYHSGISPKTSYTNLSSTVQERNKALAASSPATGWSASHAKDKPANGRADHSYQFPPAADLNAGSLLNVRKSSASSGQEASSSWMAPDSWAVQPDKMRDYLRDDNVGEEEEDDDEHARAQLAAADGKRRGSSSGVSSSHASSMFRVASTDPFKKTTSIAGSRRGTDDSVDPLTVLPPLPTNKAVDEASVNKVDVLEQTNNLAQSALAQGQSQSHSLQSGHHHGSSHIRPSSRGGAGAAMLASAGASAAAAAAGKLGLHRPSKHRMHTRPNTAGSIGATKPSTTTLSSTLSAEDDSSITSSSTRRDGHPLKRSTAATTNAAPGSALRNHFIRVYKIDGTFATLSCSLVSTANEVQTILARKSLTTESAAYRLFVRDKGSERPLGNSDKPAQLQRRRLMQAGHTESDGLEDMGRDDLSYLLRFVFRPDSVPTFDSESIGHSEHTFQHLDLHSRNLEMVPIFLYKHADWIVSLDLSGNPMSDLPLDFVQLCSSLRTLRLSNLALKRIPQSVRHSETLTHLDVSNNRIVELSHISLDLIPELMSLKVQNNRLFDLPSYFAGISTLRNLNISNNRFDEFPKVICDVPSLVDLDVSFNSITELPAEIKNLVNLERFILAGNSLEKLPDSMSELVNLRTIDLRRNRVQDVSSLLGLPRLQNIQAESNNIKSFEATLGPQLTQVELGRNPLSKVRIAALTTCDLTSLDLSSTNMTRLEEGLFPQLPALVKLTLDGNQLVVLPDTLGELKRLEMLSCSNNLLATLPESIGDLKLLKELLVHNNNLKTLPQTLWFCESLAHINLSSNLLESFPAAPDMRTDASVGDAAAAAGGSVILAARKGSTSSSLTHNINANGVNGAAVGTNASTPSEVFVAPLSLSLQKLRLGDNRLGDDVFSVLSELTSLEVLNLSFNEIFEIPDFSLQTLTRLRELYISGNQISTIPSDDLVVLQELRILHLNCNKLTTLPTELGKLKKLANLDVGNNVLKYNIANWHYDWNWNMNPELRYLNLSGNTRLEIKTKLSEMGFTRKSNISDFSRLTSLRMLGLMDVTMPLHSNATPDESENRRVRTSLSQINGMAYGIADALCKHDNLSVIDLVIPSFRKDEGECIFGLFDGRGHGAHVGSRIAHHLAEWIGHRLSWEFQKHQNEKSTEPVSVPDALRRAFLRIQKDYADALINDGSRKMSEAHAEAAADVTRSSAPAIAAASNKHDWRAGTSAILAYVVDRTLYIANAGDALAVMSRNGGTAHLISNKHEPFDRAEIERIRSAEGWVSLRGYVNDMLDVSRSFGYFHLFPIVNAAPAVTTVQLTDSDEFIIIANRTLWQYVSYQTAVDIARTQRNDPMIAAQKLRDFAISYGAEESIMVMVISVGDLFYRSDRRNGGGVNFANYQNADAFKKAGRRFREELPGDRTLARLDREVAPPIGQVALVFTDIKNSTSLWETNNGMQAAMRLHNYLLRRQLRTIGGYEVKTEGDAFMVSFPSVTAALLWCFTVQQQLLQEDWPREILDSEDGKEVYDQSGELIHRGLSVRMGIHWGRPVCEADPITRRMDYFGPMVNRAARISGAADGGQILASKDVIKELQGLLGTFDESSTGAAGAEGEQLRKTEEGLDEDAFRLLNPNVSRDVVLLRRMGFGLSQLGERRLKGLETPEMLWLVYPKQLAGRLEQAKTDDAQDAPTAQVYEPTVQLLDIEDVKQMGMLCLRVEYLSNSTVCPGIFAAQDDAERSNPATPSGETTRNPMDSDSKTISGEGGSKSKEADYHGTANSKLVLSHQARRKGVEAMLSMHPELLIYSIRDDATDEELAGILDQLTTRIQNAVSTLMVNVLREKTANGSKALSAIDPSVLELLNSLLSQSPPQVPMSASSPLTSPLTSPRSRLMELLP

SEQ ID NO: 229 - protein, 2017 aa, Magnaporthe oryzae 70-15
MTSNGTGGAPAAINTSFYNDSSDNLSVASQLSPGFRIPGGRPSISQPSGVGADNNEASYFGDERRPSIASITTTASSQGSKASGNRGGFRKLQGFFGEEFPGRDSSDTSLPPAVPGKEHRSHSYSHGRPYRDRNYSNATDHTRDGSPSSSRPRTPVPAPEVVPFLYQEADDIAKYGEAPVRDILSGPDRERYVTGDSLQNPPKTSSSSRSGHSLAHLSGQHRHQKSNDDPRTLRPTMSRDDSAVPTYKDRSGSATTMMTTSRDRAHSPAPSGHSIGGYFSSKNGTYDGQTSPPGHQKKSLLGRFKRNKDKEDTGSLKKTSLSSTSLNLKPSRSEFGGDGASTMGQDWPSRLAEPSQYNSNSNSASARPPQARHGTFKSPFAKRGRTHHRHDDRDEAIGPTDKHDGMQAGGTMFHLDTDLNDMSGILSRPLPLTPMDADFVGTIKGEKSTVTSNGRNGAWDAPDSWAVKRTGDDLAYHGPENDEAGPSPRPEEKMTSYCIRVFKSDGTFATLQMSIDSSVQDLIGQLSKKSYVSGGLEYHIALRKHGLIRVLGSAEKPLFIQKRLLRQVGFEERDRIEDIGREDNSYLCRFLFMSSRELEQQARTQDLGLGRTQKFNHVDLSARNIIRIPIYLYSKVQDIISLNLSKNLSLDLPRDFISSCQNLRDIKFNNNEARKLPASLGRASRLTYLDVSNNRIDHLENAELNGLVGLLKLNLANNRLKHLPPYFGAYRSLRTLNVSSNFLDKFPSFLCELESLVDLDLSFNLIGAFPPAIENLRNLEKLVITNNRLAGTLPDSFSRLQSLRELDIKYNAISGIDVISLLPKLEILAADHNAISQFVGSFERVRSLKLKDNPITRFELTSTVPTLKLLNLSNAKLASIAESFNHMLNLERLVLDRNHFVSLPSQIGRLRRLEHFSIAHNALAELPPEVGCLQELKFLDVRGNNLKKLPLEIWWANKLETLNASSNVMTDFPKPASRPPQPPESSPGSMQGSNGKVAMVGSLSTPPSIEDLDPDDSRRPSQASSSTLLSVGPSPVPAGPDRKSSVVSVYGKGGRKTSIISRSANSSGNAPAPPNTRKDSGLSARITNTFSGSLRNLFLADNLLDDDVFDQIMLLCELRVLNLSFNQISDMPQRCIKSWPQLSELYLSGNELTTIPVDDLEEYSLLQVLHINCNKFTNLPADISRAKKLAVLDCGSNFLKYNISNVPYDWNWNLNPNLRYLNLSGNRRLEIKQPAYGSGAGNREQYTDFSRLQNLRVLGLMDVTLTQPSIPEQSEDCRVRTSGSSAGYLPYAMADTLGKNEHLSTVDLVVPRFNASETETLLGLFDGQALSSGGSKIAKYLHENFGQILATELRALKTGLKETPEDALRRAFLALNKELVTIAIQHSEDRPSVPHRSGSQAHVILNKEDLNSGGVATVVYLQGQDLYVANVGDAQAMIIQSDQTHKMLTRKHDPAEPTERSRIREAGGWVSRNGKLNDQLGVSRAFGYVDLMPAVQAAPHVSHVAIREQDEMILLATSELWEHLAPELIVDIARQERGDLMRATQKLRDLAIAYGSTNKIMIMMISVADLKRRTERTRINRGQSMSIHNLSLHGEQYKFPTRGRRKKDQVMDSTLQRLEAEVPAPTGMIAIVFTDIKNSTNLWETYPAAMRSAIRLHNEMMRRQLRRIGGFEVKTEGDAFMVSFPTATSALLWCFAVQLQLLEVNWPSEMLNSLSCKPTVDKNNQVIFKGLSVRMGIHWGEPLCEPDPITRRMDYYGPMVNKASRISAVADGGQITVSSDFISEIQRCLETYQGANAAALVNESFDEDPFSMAIRKELRSLSSQGFEVKELGERKLKGLENPEVVYSLYPHQLAGRIETHQAHDKGVTAAAPELIENTPAVLKEGSELDFDPEIIWGLWKLSLRLEMLCSSLEYVGGRGLQAPETELLERMKQRGGEVTESFLVNFMEHQISRIETCVSTLSIRHLNMGGGTIKELDDLRGPISSVLANFSKQMAELQRYKALYGPLDAIEDGQQAS

SEQ ID NO: 230 - protein, 1858 aa, Stereum hirsutum FP-91666 SS1
MAVDAANRPYFFPVDNGKSDVQVPDRTVWVDERPGASTTPTPTRPSLSSKYPISQKNSQASFSTSPRHGSRNTNDSHSIADTWSSRADSLTPPNSYNNEHASSSRNVLRKPKSSKNLFSMLRRSKSKPRLDADDPQPPGASTSSPPSLPSYIDQDSFHPLSSTSPSKWSKPAGKHRRKHTKTSPTSSLPTTESFDLDLNVMDGIVHPHALQQATGGSPPAPTSLEVDHSPLPDTRVRTLPPVKSNAHEPIELFTNPFRAQSPPHRLNPRERNISPKSLPPLPLIAPAVTPPVLNPVLNITAEGPSEEDPTAWNAPDSWAVDPVEGQQEPEYSSSEESPASKPAASPEASAKKDKRIKRRTQTIAVKPATPTTKTLWTIRVHCPGNTFHELCLELPVTVAELTPHLDQQVLGLSEEPKPGEKRHEIHKLYLKERGRERMLAATERPADIVRRRLEQAGYEAADGLEKLGGEDLSFLLKFLYKSYALGPSEDDLEFVDYDHVDLTNKSLRTIPVPLYSHAEGIISLNLSRNPMLEIPLDFVQSCTSLEELRLSNMSIKKVPQSVRHCTSLLKLDLSCNRIGDLDAGLERIPGLTSLIAQNNRMEKLPWYLPRLRSLKHLNISNNKFREFPELLCQMTHLVELDISFNMISELPEAISDMQDLEKLIMVGNRVSRFPEGCSRLSNLRVLDCRRNAITDVTIVEMLPELEVLLVNHNSVHALDLSSGPCVKEIDVSHNDITHIILVPGPIGQIPHNLTSLNISHAKLSSLDDLALAYLTSLLELNLDYNEFRFIPDSLGELSRLVSFSCSDNKLDALPSTIGKLQKLERLDVHNNNLTEIPATLWNCASLTRINMTSNLIATWHPPIATATLPPPPTASSTLTVPEPTSSTFPIAGSERKLSSASTIGTSSSPPAPSTPSRTLPALAHSLEQLYLGENHLADDSLPFLTILRELRVLNLSFNDIQEMPSTFFKDMTQLEELYLSGNKISSLPTEGLHRMTRLQVLFLNGNRLQTLPHELGKIPSLAVLDVGSNALKYNINNWEFDWNWNFNTNLRYLNLSGNKRLEIKPDQARKGQPAESRVTIDLAAFDHLSQLRVLGLMDVTTTFAPNIPDDNEDRRVRTSLSEVNGMAYGIADNLGNKDFVSMFDLVQPIFQNRKDEAIFAMFGRAQSTPHNNLISKYLHDNFVGIFQECLSGLQKDKGETVQDALRRTFLKLNRLTHDSLFSASGNLQRKMSQASRKSSKLFSMSEATNLGASGIVLYIQGKTLYVANAGNCLAVVSRRGTAELVSEKHDPFDRTEISRIRSAEGWVSPKGLVNDEVDISRSFGFFHLLPVVNARPSIRQYELSEQDEFVIIGNSGLWDFVSYQTAVDIARSERADPMIASQKLRDFAISYGAEGSTMIMVISTASLFHNRDRQATVESLVDSDTYALARRKRKDEHIGDRNIARLDEEVPPPVGNLALVFTDIRNSTHLWETNGAMPTAMRLHHFLLRRQLRFCGGYEVKTEGDAFMVAFQNVSSAILWALNVQLQLLHEAWPKELLECEDGREIRDKEGRIIAKGLSLRMGIHCGAPVCEPDAITKRMDYLGPMVNRAARVCGCAAGGQIMLSADVVREIQARVLETGPDTDYSVYQPLHIVEAIRRLDIIVEPIGEKKLKGLEVPEMLSLVYPRALAGRRVLDGDASDDVPRENEAEGGLESIECSVDQLKELSMVCLRLEALTIGRIFRPLPPRKGSNAQQMPPPPPPPPLLPAADIRVKGQAPLEKSDGSCSTQLEAAADTPQLLCADPALLTPAIPDKPSQAEVLSILEFLMIRLELSTTSLANSSIFSTPEIVAISDALKKRRGKPLDAVRLQEILGLLEF

SEQ ID NO: 231 - protein, 1460 aa, Stereum hirsutum FP-91666 SS1
MEIGSDSSHSGSGGSHRDRRAVGAGRWDDGGGSVQTHGQVGSRSTHSPTITVNSRSLGFSVSTTYPVKIYRADESWEILPISVDVTVADLTKLLNVTMLGENEKEIHRLFLRERGRERLLAQNEKPGKIVRNRLEQAGYDPSDTLGEQVSRDLSTYLKFVYKSVVLGPPSQELSDEAASFEHINVIDQGYKVIPIVFYRRAKDIVSLNLSGNPMLDIPLDFIQSCTSLRELCLSNMAIKKVSQNIQHLPALQSLDLSRNRIGDLEDAGLDRLVHLTHLAIYNNRLNRLPSYFERMASLKILNMSNNRFPVLPDVVSKLRVLEELDASFNLISTLPDKIGDLSALVKLILVGNNISCFPDSIAALDRLQLLDCRRNNISELGPASTLPGLCVIDFSRNPVDGLQLSLGPHVDTLTLSHTEISDIVIPPIVSKDTIMLTALTLSHSNLTYLDESLFSHLSLLEDLNLDHNRLRQVPDSICDLRELRSFSCSVNSLAALPDRFNNLQKLERLDVYDNNLTAVPRSVYQCPRLSRATLASNLISLAEPVHTSVDSVASPALSSLTEVYLCENRYESSILYVIMQLKELRILNIAFNELEEIPPAFFKDLVKLEELYLGGNKLSSLPTEHLWKLTRLKVLFLNGNRFQTLPKELGKIPSLTMLDVGSNDLKYNISNYEFDWNWNHNKNLRYLNFSGNKRLKIKPDSTHAHTNSAPVHTEDNKGIDLRHLADFSALTRLEVLGLMDVTTVFSTIPDGHAGRRVRTSLSEINGMAYGIADTLSLSQNLGVFDLVHPSFRDKNEAIFAIFGNAKASSGSNLLTKFLSDRFSPTFEQELRSSPYNPGETTEGVPDALRRTFLTLNGLAYHYLLNQIREHPYLVANGSDPMKTGASGVVLYIQNRTLFLANVGSSLAVVSRGGRATALSVKHDSLDRGEINRIRAAEGWISPRGLVNDTTDVSRSFGFFDQVPVVNARPDVFKYDFTDEDEFIILGNNGFWEFISTQTAVDMARSEWADPMIAAQKLRDFAISYGARGSSMVMVVSLSSAFKPRPRQATIESLGVVGESDLGSPLRWKRKEDVIDRSTILEDATAPVGHLALVFTELKHSDYLWESNPGMPEAARMHHEILRRELHSCGGYEVKREFDTFMVAFETVSAALLWCLRVQIELMDADWPREILEWEGGREVLGWDGQIVMRGLSVTMGIHCGTPACEPDAITKRMDYFGSMVNRSARINSAADGGQIMVSADVANEIRATVLGNGPKTEYSAYQPAHIVDAVKKIGIYLVSKGEVKLKGFEVPETLSLVFPRRLVGRHETVILSEESDSEELAEMDEVDPQSVQYLRDLSQECACLEGIASQKLRDSSSSLTTAAATLTSSGIDETAASGYSTHNFTHLQSAIPDKPCEDQVSSGIDFALLRIANAASVLNEPVPAMPSLSDSAKIMAAFGGRRGQPLGPEKLKRLLELLEP

SEQ ID NO: 232 - protein, 1542 aa, Punctularia strigosozonata HHB-11173 SS5
MQLENGSSPSWTAPESWFVDSSKQQEDEDALLCSSDEDVTHQQYPGAPQNREKERKERDKDRERDKDRADRYKDPPNSGFDRLDPASAERERERRERRKSKRHSRPLPPSASPYQSYKIRIYRANNSYHVVSIAPVVTVEDLVPTLNKKLLLGADVEAHRLYIKERGRERVLAATERPANIMRKRLQQAGYDFADRLETMGLEDLSFLMKFVYKSNLLGPAVCEEDLNLENFEFIDLNARALKTVPIILYTHAPSIVSLNLSRNPMVEIPLDFVQSCTTLRELKLSNMAMKKVPQSVRFCLPLHRLDLTSNRIGDLNEAGLDQLPELVSLRLQNNKMSELPWYFARMSGLTVLNISNNKFRRLPAVVCEMTGLLDLDISFNSIEELPEELVQLRKLERFVIVGNRITRFPAECATLERLSVLDCRRNAITDLSTVAMLPSLTQLRADHNAIHALELCLGPQLSKLEAANNDITQLTLMPGPLGSPYKLTTLDVSHAKLSMLDENALSQLISLTTLKLDHNSFRAIPETLGNLAQLTTFSCSNNQLDALPSTIGQLQRLETLNVNSNSLTELPAELWNCASLLVLNATSNLLETWHDPPLQTLPAVAPPPTLTVTHVATEHGIYGDRKLSTADSIASQKDRNRLLPPLAHSLEKLYLGENRLTDDVLIPLTILRELKVLNLSFNLIQDLPPSFFRNLSNLEELYLSGNKLSAIPTEDLHKLTKLTTLFLNGNKLQSLPQELAKLTSLQVLDVGSNVLKYNIMNWEFDWNWNFNAGLRYLNLSGNKRLVIKPDTSSRGHSLDRDQRRVLADFSALTQLRVLGLMDVTTTFLPNIPDEGEERRIRTSSSEVNRMGYGIADFLGMTDHQLTMVDLVKPEFRERPNEAVFAMFGRAQPHTSNNKLSKWLGDNFVQVFSNMLKDLDQEQGEGAEHALRRTFLKLNKYMYDYLLSQAASQRKSSQASASTNATNLRDYTLIRSGAAGIVLYFVDKTMYVANAGNALAVVSRQGDARPVSRKHDPFDRDEAARIRAAEGFITPRGLVNDEIDVSRGFGFYHLLPVVNPRPDICAYELSPLDEFVIVGNRGLWDYVSYQTAVDIARTERADPMIAAQKLRDFAISYGSEGSTMIMVISVGDLFKDTTRPRQATLDSIIDPQDYPMYRRVRRGDIFDLSINRLDPEVPPPVGHVAIAFTDIRNSTHLWEVNSGMPTAMRLHNNLLRRLLRFCGGYEVKTEGDAFMCSFPTSLAALWWCLSVQSQLLDQAWPLEILECEDGQEIKDNEGRTIAKGLSVRMGIHCGYPACEPDPVTHRMDYFGSMVNKAARVNGSAAGGQIAVSTDVIREIHASIHRTEPATEHSHRQPQQAIDAINRIGIKLFEKGEVKLKGIELPERLAIVYPAELAGREELEQTSEASKVSASRVQFSVEQIRELAALCIRLETLTTSRVLRPHPTSNRGTEADAADSDSVFVHCDPNLLLPAISDKATDTDLKMLLVSLSIRIENALATLALKYIRESVAGPTVISALQTSGLDDKTLSLLRTLCTSSLV

SEQ ID NO: 233 - protein, 1610 aa, Trametes versicolor FP-101664 SS1
MPSPDLSFHPTPTTPPGSFSKKDRSTRKKKPSYPNPPTVPPKSSLHPLDTNLDEMDGIVDLAAFPPANPDSNSPGSGFESSHQSSSDVSSMQFGSIGASQHSVFTNPFLSGSQRRLAPGALVYDGRRISPKARPPGMVPTVGVEGDPPSWTAPESWAVEKDVDPSITAYSSSDESVQGAKVTTPPQQPRTTTKQKKKPRNPQPKGLYKVRIYRANNSYHVVSCDLNVTVAQLTPQLNKKLLLDPGVEPHRLHLKERGRERVLAPTERPADIVRRRLEQAGYDFADGLDLLGADDIQFLLKFVYKSNVLGPPEDEMQFDSFDLIDLTSRSLRAVPITLYAHADAIVSLNLSRNPMLEIPLDFIQACTTLRELRLSHMALKKVPQSVRHCRTLQRLDLSCNRMTDLDDAGLEKIPQLRHLKLQNNRMDALPKYFVGMHELRDLNISNNKFKDVPSVVCGLQSLVDLDVSFNMITVLPQQLGQLTQLEHFIIVGNQVSRIPEMFANLRSLRVLDCRRNPIVDISVVCTLPKIEQLLADHNSMHALDVSFGPSLKELDASHNDITQLTLVPGPLGLPYALTTLNLSHAKLSTLDDMALAQLTALEVLHIDHNSIRSLPESMGGLSRLKHLSCSNNHLFMLPSSIGRLQWLEKLEAHNNDLSELPMSLWNCSSLQVINVTSNVISTWSLPPGSIDLDVAVSHAWGSSSVSLLSDRKGSSSSIAGSSLPALASSLEELYVGENSLTADSLHPLALLKELEVLNLSFNSIQQLPSSFFRNLVKLRELYLSGNDISAIPTENLQHMVSLEVLFLNGNKLQTLPREISKLTKLSVMDVGSNVLKYNINNWEFDWNWNFNTNLRYLNLSGNKRLEIKPDMNHKQSRGQQQLSDFSSLTQLRILGLMDVTIGMQTNIPEESEDRRVRTSMADVNGVAYGIADTLSIRGATDQLTMIDLVQPNFRGSPDEAVFAMFGRASHVASNNKLTKFLHDSFLRVFAEELARLSRSEEIPDAMRRSFLKLNKLLHDYLYSTSGRKMSHVSASAMSQAVHDKIGASGIVLYLVDRTLYIANAGNALAVISRQGIARLVSRKHDPFDRLETARIRAAEGWVSPKGFVNDEIDVSRSFGFYYLLPVVNPRPDVYKYDLTTLDEFVIVGNRGLWDYVSYQTAVDIARKERDPMIASQKLRDFAISYGAEGTTMIMVIRVSDLFPKGLPGDPQGSPEPVIFPEELIRMVKNQKPKTGIINSAISRLIEEVPPPTGHLALVFTDIRNSTHLWEVNPGMQSAMTLHSNLLRRLLRFCGGYEVKTEGDAFMCSFPTTLSALWWCMSVQTQLLELPWPLELLECEDGKEIHKGGRLLARGLSLRMGIHCGQPVCEPDPVTGRMDYFGPMVNRAARVNAVAAGGQIMCSADVIKEINARILETGPTTDHSHHQPLDAINAIRTMGVAIFPVGEVKLKGLEVPEYLSIVYPESLQLRQDLEPFEAAPTASGSRVQFSVEQMRELGLLCVRLETLAMSKVFRPTPVRKGSIASVSATTKPEDDTKSALVVYDDPSLYLPVMDEKSTDAALTTVLHSLSLRIDNALTKLAFMYMSDIERERGAPDLALRDQILELCRPIML

SEQ ID NO: 234 - protein, 1342 aa, Tremella mesenterica DSM 1558
ILCRFIYQTPALPVMDPEEESHYDSFEFIDLAGRDLQTIPIFLHLHAHNIIILNISRNPMTDIPLDFIQACTGLKELRMSNMALKRIPASVPASTTLARLDVSCNRIADLESVPLHEIQSLLSLKLQNNRLISIPSYFAMMRGLKYLNISNNKFDTFPRVVCEMSNLVDLDISFNEIADLPSEMSNLKSLERLMAFGNEISTFPQSFSTLANLRILDVRRNKLVDLTSVYALPNLETLQADYGNLVTLDLQIGARVRQFSVPHNSITRFTLAPLPGVAARTYSLTHLNLSHGKISTLADEALSGLVNLIDLNLNFNQFTRLPPTMDRLTSLQIFSCTDNLLESIPQGFVKMQSLHTINLHNNNIKDLPGDLWGCGSLKSINVSSNLLEAIPEPPANLFEMIPAETRRRMSVDSNSSMTGSRLPVTLSLEKVLLADNRLNDDAFHAIAPLTKLKVLNLSFNEIFEIPPYTLSQVTSLEELYLSGNKLTSLPSEDLEKLQNLQVLYLNGNKLQTLPSELGAIKTLKHLDVGSNVLKYNIANWPYDWNWNWNTSLRYLNLSGNKRLEIKPTSAQDMSHATTLRKELSDFTALTELRVLGLMDVTLRIPSLPDESEAKRVRTSFSDINNMAYGISDMLGSIDHLAMFDLVVPNFRGRENECLFGMFGRSAPVVPSGKIPKYLQENFAEQLSVQLDSLSSSEEPSTALRRTFLFSDRKVYDYLVSGVTNSQRKQSTVSMTPSDHLSNSWNTPSGLDQPWAPAVGSVFRTGATGAVVYLIDKTLHVGNIGDMLVVISRKGEAELLSKPHVPTDREETARIRNAEAWVCTRGYVNSDKEMDVSRAWGYWSHFPAVNAAPEIRTRVLAESDEFVIIGNHALWQCCSYQTAVDIARTERDDPMMAAQKLRDFAISYGADGSVMVMVVNVSDLFFSKSRPRGGGSGSQVPADGGEAYFAGLKRNIRRRYEEVGDRTLNRLQQEIEPPTGQVAIVFTDIVNSTHLWETNPGMPTAIKMHHNLMRRQLRLDEGYEVKTEGDSFMVSFQTITAALLWCFNCQLGLLSQEWPRELLECPDGGIIYDSEGNIVHRGLRVRMGVHWGQPQCERDPITRRMDYYGPMVNRAARINASADGGQLMASQDVINEIELMREYLDSLDETALEDMPHELKRELQELRRIGVESRDMGERKLKGLEVPERLYLLYPKVLVGRLELSSDLRASVEVGDHRPLAPTRQIDIDQVRQLSLIVLRLENLSVNTKPNGSSGGMAIGTEIQRWKLKPPVAHLGPQIREEMTDEELCLVVESLVTRAENCLSTLYLKNLGGFGGVMAALEQATRIDKKLLVHAMSLMSGAM

SEQ ID NO: 235 - protein, 1874 aa, Ashbya gossypii ATCC 10895
MDRKAHRAGERRAAGRTDGRGGWERGADGLAAGSRRDSVDDSWSSLSSNSQEAPLEHEVRSGGRIVEPGSDLPPHMKHSRGLHHASFARVSQHPSSPLAKQLRPVRNVTMQSAAEDDDARATGAPPPIRRIPSRAGSFFKRLTGRKSSINGSETSAAADADVAAAPSSLRRKVNTFIHGNEARRDSKGTISTSSADSRRGSTASGGSASIIQLPDGQRLSLQEYKPVSPTTTALSSASSAAAQQGGDRSTGSPVHVPWDNAEASNEHESGVNTTFFNLDMDLNNLSDITSAYQQQTETTTNANLEVNMANAGKPVVHMPRPQKLPAREVRHTKGAAQWTAPESWDVDDPVIKPSKQKQKCHNPAHRHHRHHYSPRSDMTGTSGDNNRLSADPNRYSNLEDSPNHSRLTAAFSRSPIHRDMSPLSIMSSDSIVSSNSDSCSFSVVSNPEDTPKDITHPDNASTSSIHAQELENNDIEDDKLQHHLEKYYNHFSDIDYHKKYTIRIFNTDDTFTTLSCRPETTVKEMIPQIKRKFNVPPGNYQVSLKVGKLSKVLRPTAKPILIQIRLLLFNGYKKTDRLNIMGIEDLSFVFSFVFHPVITSQLTYEQEQRLSKGEFVHVDLRNMDLTIPPIIFYQHTSDIESLDVSNNANIFLPLDFIESVIKLSSLRMVNIRASRFPSNICEATKLITLDLERNFIKRVPDQMSKLTNLTILNLRCNELDRLPRGFKDLKSLQLLDISSNKFNIYPEVINSCTNLLQLDLSYNKIRSLPDSMNQLQKLAKINLSNNRITHVNDLSKMTSLRTLDLRYNRIESIKCRVPNLQNLFLTENRLTMFDDDQLMLRTLELQRNPLSILTLKNDYLEHLTSLSISKAKLAVLPESLLRRLPRLEKLELSENSLTVLPPDIKHLKKLVHLSVAKNKLESLPDEIASLKNLKMLDLHCNNLMTLPAALSTLSLTFVNISSNMLSGHHELYRTFQGTSNIAKSLMFLSAADNQMGDKFWEIFNTFKTLKVLNLSYNNFMALPELEMENLTELYLSGNHLTTLSGEAFLKLKSLRVLMLNANNLQSLPAEISQLSQLSVIDVGSNQLKYNISNYHYDWNWRQNTELKYLNFSGNTRFEIKSAMEYGTNMHLSDLTVLKQLRVLGLMDVTLNTSRVPDDGVNFRLRTMGSTINGMEYGVADSLGQTDSVSTRDVTFERFRGNEDECLICLYDGINDNTNTGHKISQVIRDIYDRILVRSLEKYGDSTPAEIRDALRFSFLQLNKEINSSILAAGNNKNSNGNTNNNNNTNNNNNNGNNNTNSNGESVVLTAADSLSGASVTVVFMKGKNIYTANIGNATAILSKGNADYRILTRKHVPTDTEEFERIRLSGGYVDNKRVNGVSEISRAIGFFDLLPHIHASPDISETTLTYTDDMLVIATQSLLSYVSLEKICDIARENKSQPMLAAERMKDYAIAYGCTDNITILCVSFNKNVGKQKQFSLNKSDLLGRRLNFEDVSLRRLRPEIAPPTGHLAIVFTDIKNSTFLWELFPNAMRVAIKAHNDIMRRTLRIFGGYEVKTEGDAFMVAFPTPTSALVWCLTIQLKLLELDWPEEITSIKSGCMITDDSGNTIYQGLSVRMGIHWGCPVPEVDIVTQRMDYLGPMVNKAARVSATADGGQITLSSDFLAELNKIMKLHHMVVQDKKPLKEVYGEEFVGEVLEREIQMLDNVGLVLEELGEQKLKGLETREFITIAYPKQLAARHTMSTGEKSTNIVNDKYVLQLKVISTTLENILSTVNGGLIEIDNSVLQLPTHMTRDKKVDKALSQNTEYDWISLLDHLVTRLESTVAMLQLRQRLEGGLEICRPGNNTKKSVFELLDLLCTGTGFKRDTPSENK

SEQ ID NO: 236 - protein, 1693 aa, Gibberella zeae PH-1
MASADFCDDSEDITRKRTMLLPDFATCPNPQGLCKQTTAQRGATFNNKFPFAKKTRTHRPQDYPEEAIGPTDRNDPNNMYHLDTNLNDMEGILTKPPPLTPMDTTFVNPVEPERHDSIISTAPKGRWDAPDSWAVRRNTEDNSYNGGPELDEIGSPPRPEEKASPYCIRIFRSDGTFSTHSMSLDSSVTDVISQVIKKTYVMDGLENYHIIMKKHDLIRVLTPPERPLLMQKRLLQQVGYEEKDRIEDLGREDNSYLCRFMFLSARESDFHAKTTDMGLARAQKLNYVDLSGRNLVTIPISLYSKAMEIISLNLSRNLSLDVPRDFVQSCKHLRDIKFNNNEARKLPPSLSRANKLTYLDVANNRIEQLEHAELNALTGMIKMNLANNRLKHLPSYFGAYQSLRTLNISSNFIDKFPTFLCGLPSLVDLDLSFNAIATIPQEIGSLRNLEKLLITNNRLTHAVPATFGQLVSLRELDIKYNGISSIDIISELPKLEILSADHNCVSAFVGQFESLRKLKLNSNPLNKFEIVAPVPTLKTLNLSNAQLASIDSSFANMVNLERLILDKNYFVSLPQEIGTLSKLEHFSIANNSVGELPSQIGCLTELRVLNVRGNNISKLPMELWWANRLETFNASSNVLEHFPKPASRAPRIPGEESQPAPPPVNGRAAPLGTLSATASSEELSDDRRPSQNSSTLLSVGPSPLNAGDRKSSVVSVYGKGGRKTSVVSRSATPSAPTQSVNPRKDSGLSSRLNNTFAGSLRNLHLADNRLDDDVFDQITLLTELRVLNLSYNDEISDMPQRSIKSWPQLVELYLSGNALTTLPADDLEESSLLQALYINGNRFTNLPADISRAKNLAVLDCGSNYLKYNISNVPYDWNWNLNPNLRYLNLSGNKRLEIKQTATGPLGPGAVNREEYTDFSRLLNLRILGLMDVTLTQPSIPDQSEDRRVRTSGSLAGHLPYGMADTLGKHEHLSTVDLVVPRFNASETEMLLGLFDGQALSSGGSKIAKYLHENFGHIFALELKALKTRLNETPVDALRRAFLALNKDLVTIAIQQSEERPIQTHRNSGQPIILTKEDLNSGGVATVVYLQSTELYVANVGDAQAMVIQTDGTHKMLTRKHDPAEPTERSRIREAGGWVSRNGRLNDLLQVSRAFGYVDLMPAVQAAPYVSNMTIREQDDIILIATGELWEYLSPGLVTDVARAERQDLMRAAQKLRDLAIAYGASGKIMVMMISVADLKRRVERSRLHRGASMSLYPSGIPDDAQVLNIRRGRRTKGDVLDSSLNRLEAEIPAPTGNVSIVFTDIKNSTTLWEMYPSAMRSAIKLHNEVMRRQLRRIGGYEVKTEGDAFMVSFPTATSALLWTFAVQMQLLDVNWPSEVLNSVSCQPIFDKDNSLIFKGLSVRMGIHFGDCVSETDPVTRRMDYFGPMVNKAARISAVADGGQITVSTDFISEIQRCLENYQDTDRGNASGSEDTFGDEETYASAIRKDLRSLTSQGFEVKEMGEKKLKGLENPEVVYSLYPHALAGRIEFHSQHERKEEGGGDKPAVLAPGTELCIDPDSVWTLWRISLRLEMLCSSLEGNEPPGLQPPETELLERIKQRGGEVTDRFLLNFLEHQVARIEELEDLHGPMSAILDQFMAQNRELKRYRRKYGALPNPVNSLSSSEEEEEEDDDDDDDDPDTEEGSNTEQEL

SEQ ID NO: 237 - protein, 2082 aa, Candida glabrata CBS 138
MSRRSESNRTHLEQGTYSKKVHDEQPRFKSTYDQQDFSGTSSRRNSTIQNVYSSIGGLTRTRSRDSVSSIKSNPGEFPSNKNYQHKSKKSPFSLKRTLSNLSVTNMLQTQTPSSLQNMAFEDEIDQKIDSSNTTDVDSIGSMSDRSFTSRVASNSENDHTHHRKHGSTSRKYSFAENLFKKLAPSNSSTKTSHKGQTTRRTAGLTHSKPTAETISELPGEHDLTNVKFPPPLAEIGADGLRNKVKQIVRGHSTSGIAIANDGSTRSSIPLMKELEKKKLKHKDQEKHQSESSSIHSSQGNKKLFLSTGSSASSRRGSTVNSILTNDNRSSVSNPKEPKSVLGEPSHNNQTKDINTPNQKGFTTAQRANSISVPSKSHKFNAIDPENTIEARFNESTLDKEKDESIKEKDNSDNKGNDENNAEDIKTENPNTGLFPLDTNLENMAEITKNVEPPSEADKEPITRSNTFISGPKKSHSIADIPTWVSSESSLKDYTQTDRDQWVAPESWDVEMRMGGSNANHLENEEEPFDSILSPEEVTMATQQKQRRNKSNNKSSKSRNGSEVNGKKPLSTKSMVRIKNSLFMSPTSNDTENSSDLSRNGGINFNSKLGSSRVRKSSSDSLASIISPTESLHSDDDKQSTTSRSSYNSSTSNQYPDNIDDENEEYELQLNARAARKRKTISSSELFQKMNDGTDNSDSNENISADIDDERHDNVEYELERYYKDVSDLDPKRHYAIRIFNTDDTFTTLSCTPGTTVEEMIPALKRKFNITTQGNFQISLKVGKLSKILRPVSKPILIERKLLLLNGYRKSDPLHIMGIEDLSFVFKFLFHPVTPSHFTPEQEQRLMRSEFVHVDLRNMDLTTPPIIFYQHTSEIESLDVSNNANIFLPLEFIESAIKLLSLRMVNIRASRFPANITEAYKLVSLELQRNFIRKVPSSISKLVNLTILNLQCNGLDRLPSGFSQLKNLQLLDLSSNRFAHYPEVINFCTNLLQIDLSYNKIHHLPKSCRQLVKLAKMNLSHNKLTHVGDLSELKNLRTLNLRFNRINTINTNAPNLQNLFLTDNRISNFDENLPKLRALEIQENPITSISFREYPMNMTSLSLNKAKLASIPGEIFKKLLRLEKLELNENNLTRLPSEISLLTKLVYLSAARNKLESIPQEFSKLKSLRSLDLHSNNIRDFFAGMEDIELTFLNISSNVFANASLDPSFFLNVSNDSKLSKSLMFFVAADNQFDDDAWPLFNCFTNLKLLNLSYNNLQDITKMKLENLTELFLSGNKINTLPGDTVSKWKYLKTLMLNGNQLLSLPAELSQLPQLNVFDIGSNQLKYNISNFHYDWNWRNNKELKYLNFSGNRRFEIRSVTNQELQTDLSDLTVLPHLKVLGLMDVTLNTTKVPDENINFRLRTTASIINGMNYGVADTLGQRDYVSSRDVTFERFRGHDDECLICLHDSKNQNSDYGYNISRIVRDIYDKILIRQLEKFGDSNEDEIKKALRFSFLQLNKEINGMLNSVDNGANIDNLTSADLLSGACSTVIYMKGTKLYAANLGDCMAVLSKNNGDHQKITKQHVPTKREEYERIRLSGGYVNNGKLDGVVDVSRAVGFFDLLPHIHASPDISVINVTKADEMLIIGTHKLWEYMDIETACDIAREHVLEPMLAAEELKDHAIAYGCSENITILCLALSKSNSQESKFTLNRSSLLSKRSTVEDTTLRRLQPEIAPPTGNLAVVFTDIKNSTFLWELFPNAMRTAIKTHNDIMRRLLRIYGGYEVKTEGDAFMVTFPTPISALVWCLSVQLKLLEAQWPEEITSIQDGCLVTDRNGTKIYQGLSVRMGMHWGCPVPELDLVTQRMDYLGPVVNKAARVSSVADGGQITLSSDFVSEFNKIMKYHDNVVKDKKPLKEVYGEEIIGEMLEREITMLESIGWSFFDYGEQKLKGLETKEFITIVYPKSLASRHEFITEEEQSKIINLDFLLSLRQLANKLEAILSAVGGGFLELDSKQREYHSVIDRSLKGVVAASMSDKELILFFDHLVTRIETIIAVLQLRIKVTKGLDICQHHDFCLPQKGIFEVLDDVFKLMDAAKQIQN

SEQ ID NO: 238 - protein, 1344 aa, Cryptococcus neoformans var. neoformans JEC21
MKPANLVCRFIYQAPILPIMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISNFPESFSTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLITLNLNFNQFTKLPATLDRLTSLEVFSCTDNMLNLVPAGFGKLRRLRVINLHNNNLKSLPEDLWACGALEIFNASSNLLDSFVPPPADIESVVGRVGSGTSQTSNGRKKHSVPPIGLSIRKLFLADNRLNDDIFHWISLMPSLRIINLSFNDIYEVPPFTLCKCERLEALYLSGNKLTSLPSEDLEKLQSLKVLHLNGNKLQTLPSELGAIKTLQHLDVGSNVLKYNIANWPYDWNWNWNTSLRYLNLSGNKRLEIKPTSAHEMNHASSFRKELSDFTALTQLRVLGLMDVTLRIPSLPDESDEKRVRTSFSDINNMAYGISDMLGSIDNLAMFDLVVPHFRGKENECLFGMFGRATTTLQGGKIAKHVQEIFAETLTAHLHKLEPGEEPSEALRRTFLWGDRKAFEFFSGKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMIAAQKLRDFAISYGAEGNVMVMVVNVSDLFLGKGGRARGPSEQTAADASTDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVHDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVCQLSDIALRLEAVCSYNPTPSSPGDTPTAGVMRLHPPASYLGPSIREDMNDEELWTIIESLVGRIENAMSTLYLKNFGEFSTVLAALESATKIDQKLIVHALALMNEAMGNAEENAI

SEQ ID NO: 239 - protein, 1589 aa, Metarhizium anisopliae
DPRTGAHRAATFNNKFPFSKKTRPQRPFDYTDETIGPTDYNDPGHVYHLDTNLNDMEGILTKPPPLTPMDSSFINSIESDRRESTLEGPKGRWDAPDSWAVRRNTEDNTEDVPEVDEIGSPPRPDEKLTSYFIRIFRSDGTFSTHSMALDSTVTDVISQVIKKTYVVDGLENYHIIMKKHDLIRVLAPAERPLLMQKRLLQQVGYEEKDRIEDLGREDNGYLCRFMFLSARESDFHAKTMDLGISRSQKLNYVDLSGRNLVTIPISLYKKAADIISLNLSRNLSLDVPRDFIQSCKQLRDIKYNNNESRKLPLSLGRAGRLTFLDVSNNRLEQLEHAELNSLTGLLKMNLANNRLTHLPPYFGAYQALRSLNISSNFLDKFPPFLCQLHSLVDLDLSFNAIASLPDELGNLKNLEKLLITNNRLADEVPEGFRQLLSLRELDIKYNSITSIDIISELPKLEILTAAHNHISSFVGKFETIRQLKLNSNPLNKFEIVEPVPTLKTLNLSHAQLASIDSAFSNMINLETLVLDKNYFVSLPQQIGTLSRLEHFSIANNSVGELPPQIGCLTELRVLDVRGNNISKLPMEIWWANKLETFNASSNVLDAFPKPASRPPRVPGEEPTGPPTVQNGKPLPPNPIPSTPSSEDLSDERNPSQASSTLLSVGPSPVLATADRKSSVVSVYGKGGRKTSVVSRAASQATNSTTPPPTTARKDSGLSSRLTNTFAGSLRNLYIADNRLDDDVFDQIILLSELRVLNLSYNDEISDMPQRSIKNWPQLVELYLSGNGLTSLPADDLEESSLLQTLYINGNKFTNLPADISRAKKLAVLDCGNNYLKYNISNVPYDWNWNLNPNLRYLNLSGNKRLEIKQTAWGGPDGPGAVNREQYTDFSRLLNLRILGLMDVTLTQPSIPDQSEDRRVRTSGSLAGHLPYGMADTLGKNEHLSTVDLVVPRFNSSETEMLLGLFDGQALSSGGSKIAKYLHENFGHIFAMELKAIKNRPDDTPTDALRRAFLCLNKDLVTVAVQHTEERPKAAHRGSAQPVVLSKEDLNSGGVATVLYLRGTELYVANVGDVQAMVIKTDGKHEILTRKHDPAEPSERSRIREAGGWVSRNGRLNDLLQVSRAFGYVDLMPAVQAAPHVNKMTIKEHDEIILLATSELWEHLAPSLITDIARSERQDLMRAAQKLRDLAMAYGASGKIMVMMISVADLKRRVERSRLHRGTSMSLYPSGIPDDTQVLSTRRRGKAKGDVLDSSLNRLEAEIPAPTGNVSIVFTDIKNSTTLWEMYSSAMRSAIKLHNEVMRRQLRRIGGYEVKTEGDAFMVSFPTATSALLWCFAVQMELLDVSWPSEVLNSMSCQPIFDKDGALIFKGLSVRMGIHFGDCVSETDPVTRRMDYFGPMVNKASRISAVADGGQITVSSDFISEIQRCLENYQDTERNASGGSDEAFEDESFAATIRKDLRSLTSQGFEVKEMGEKKLKGLENPEVVYSLYPHALAGRIDQHQQHERRDEGLDRPAILAPGSELSFDPESIWALWRVSLRLEMLCSTLEEVRGSGLQPPETELLERIKSRGGEVTQKFLLNFMEHQVTR

SEQ ID NO: 240 - protein, 2132 aa, Aspergillus nidulans FGSC A4
MAFPGGELPEGRHSSESSGNNSGLSQETIRDDGRRYGRIVPSGRSISPHSKDDGSDRLELPAPRPPSLGAPNDLYTSMFSWGSPDISPTDVRKNQGFGSHRKALAVLGNDDPGPPPINNPSPRVNTNYGDYFQHDPQGTLSYSPRLGTGDAHGTFFHDHSEHEASPATATFRPGTGRTLASDAPDLDYNGDHRRPSVASATTVSSQGSKSSTSGLFRKKLQGFFGDDPNASDSKQDHDGHHSSGSKPSSIDYFRSRQRADSEGSRRPSDGVQDDAHQPGRPRTPLPSSDITPWEYQRYNDIPQLGEAPVREAPTALDRHRIGSQGASSTSRDPTRRHFSGHRHSRSKEEKANAAGDLAGYPDRPSTGRDDFSVGLRPSRDGSLGFRPAANSSINLAGRSTSPTPSLQSFYTKDSGQGSPGAPSSKRSFLGKLRRPNLKHFPGSKGPTDAIRGTSKLARRDASPGRRGRQGSLEGAPSKGAENGEHERKKDGKGLGIATGKLRGRRGAGHETPIGKETNPSEAPGVWALDTDLSHMEGIVQPAADDGDKTNEGKTVRHDEKRLGDQLGAGNWDAPESWHVKRQRNEVLAKVPKMTNDAARTIAEPDGVPYFIRVFRIDGTFATLSNGLHATVADVLLSLGKKSFLTDHLNNYEIVMRKNDISRQLDPNEQPILMQKKLLEQIGYTEKDRIEELGREDHSYILRFTFLPTKLSGYSSLEGEPGFSKNQKFSHVDLQGRSLVTIPIALYKKAPEIISLNLSRNLELDVPKDFIQGCINLREIKYIGSEALRLPPSFSLASRLTYLDVSNNFLDQLDHANLDRLQGLVSIKLANNRLTKLPDYFGNFKSLRSLNIASNNFQVFPEFLCNLKSLVDLDISFNNISELPNIGNLTSLERLWMTNNGFRGPFGESIKDLVNLKEIDARFNEIVNIDSLTLLPRLEQLLIGHNSVSKFRGSFPKLRNLVLDHCPVTQFDIDAPMPTLTSLNIASAKLVQFRDTLFDSLPNLTKLILDKNHFMSMSPHIGKLRKLEHFSMAKNPLSSLPPSIGCLTELKYLNLRECNLRRLPQEIWYCLKLETLNVSSNVLDSFPKHGGPPPQLPGEATAGTTPAMTPGGSVTPSYDDLGTVEEQETRRPSQASGSAPSGSSPGGGSTRKPSVASSLSQGGRKVSTASKFAEGSPSSRKDSNFSQHVATTFGGSLRNLYLADNRLEDDVFRELSFIPELRIVNLSYNVLNEIPPGLLKRWPLLTELYLSGNELTSLPSDDLEEGSSLKILNINANRFQVLPAELCKVSKLSILDVGSNYLKYNVSNWPYDWNWNWNRNLKYLNFSGNKRLEIKPNVSSLGSQPPNGADLTDFNSLTHLRVLGLMDVTLTTSNIPEENEDRRVRTSASLAGSLAYGMADFLGRSEHLSIIDMIVPRMRQDNVETVVGMFDGQPSSTGGSRVAKFLHENFLHTFSAELKRLRRDEQETPLDAFRRTFLTLNRNMAFACYKSIDQDVRLFQEDSSDQKKVRLNKEDLQSGGVATVLYLNNTDLYAANIGDAQAILVKSDGSMRYLTRNHDPAEAGERARIRAAGGFVSRNGRLNDYLPVSRSFGYFNLMPAVIAAPHTMHVSLTEQDEMIILASKELWDYVTPDLVVDVTRAERRDLMVAAQKIRDLALSFGANNKLMVMILGVGDLRKRERRPPRFPSMNSFSQVDDSILPSPKRTKKPRDMPGDSRLARFDYVDAPTGELAIIFTDIKQSTGLWETCPDAMRSAIQIHNDILRRQLGIIGGYEVKTEGDAFMVAFSTTTAALLWCFNCQYQLLEAEWPTEILEQPQCQVQFDMENNIIFRGLSVRMGIHWGEPVCEKDPITNRMDYFGPMVNRASRISAVADGGQIFVSSDFMNDMQRNLELFADSERAASTGSEESYALDLGDNIRRELQQLNSQGFVIKDQGERKLKGLENPEPLYLIYPHALSGRLSTQDQMSGEESTPTTISQHSQLQIQTEAIWRLWEITLRLERLCGALEHPGEPRLDKPNSALFDIIKKHGGELADSSVVSLIEQQVTRIEVAISTLALRHMLRPFKPGDRLDDHAAPIGDVLQELRTQLAEYRALKEQIATNGAGITGASPSSTATDLHYTPDFHSSASSSSFT

SEQ ID NO: 241 - protein, 2493 aa, Ustilago maydis 521
MLFTMQFTTRSTVASPEQQHQHQQRSISYSDIELGLERISSRDSNGSSNFTHRAYPPPLSQQYDDTSTNSFHSSQPDITASSSTLSSRLVSANYSRPRFEHAHTQPPTPDQDRSSSGSGSGSGSRSYFPANSHSDSLPGPSTHSISPSFDEDELRQIMSHIPANQATSSSDGDVGKAVQSANHQDISPFLFQSENAAPFSSSHSNRTSVNPSAASTASPSTSAATRTRPRGGTNASQYNTLDTSFGSIDRPGLSSSRSQYSLRPQTPPSASTSTSTLNGSKDTHASAVKKTRNPFGFLKKKSSAHSNASSNHPTRHDIGSVSSLSSRYGPNAAANVNPMRPPAWLDNHCTLANSNSPSSASLRSHYHQPPASSNPPPWQNPLVSRADSTPSAMSLEDEVEAEHHLKKDPRKRIKGVRHHLAKTTKPGEDADSARDPAFAAQSQSIEQEVELSLDMNFDQLDDFVDTNAARQRLQGSITESASPSEHRSPNGSEAGVYRSPSPSQTPIAERQTSVTSTVESPSHASEASLAPSGSLRTPSRTTASTSTSSASTVLSDRLPSQVNMLPRNSVPRLSLAEMQNYQSLRKLSNNLIDMSQTQNPSAMGASYRRGSIAAAQAPVDAPQLGVAPRTDSELSDRKDSVVSTHSMRSNHSGISPKTSYANLPSVIQERQKPATALPSAANWTSSITRDKTANGHADHAYQFPPATEYQSNLLLSVRKSSASSGQEPSSSWMAPDSWAVQPDKMRDYLRDDNVGEEEDDDDDQHQARAALATDGKRRGSSSGISSTHASSMFRTSSTDPFKKTASLAGSRRGTDDSVDPLTALPPLPGSKSVDEAAANKVDVLQQTNNLAQSALVQQQSQSQNHHQPSPNVRPTSRGGAGAHMFASAGASAAAAAAGKLGLHRPSKHRMNARPNTAGSVGATRPSTTTLGSTLSAEDDTSINGSIRRDGHPLKRSATANTNNATGTLPRNHFIRVYKTDGTFATLSCSLVSTANEVQTILARKSLTTESAAYRLFVRDKGSERPLGISDKPSQLQRRRLIQAGYTENDGLEDMGRDDLSYLLRFVFRPDSVPTFDSESIGHSEHTFQHLDLHSRNLEMVPIFLYKHADWIVSLDLSGNPMSDLPLDFVQLCSSLRTLRLSNLALKRIPQSVRHSETLTHLDVSNNRIVELAHVSLDLIPELMSLKVQNNRLFDLPSYFSSISTLRNLNISNNRFEEFPKVICDVPSLVDLDVSFNSITELPAEIANLINLERFILAGNELEKLPDSMSELVSLRTIDLRRNKVQDVSSLLGLPRLQNIQAESNNIKSFEATLGPQLTQVELGRNPLSKVRIAALTTCDLTSLDLSSTNMTRLEEGLFPQLPALVKLTLDGNQLVVLPDTLGDLKRLEMLSCSNNLLATLPESIGDLKALKELLVHNNNLKTLPQTLWLCESLAHINLSSNLLESFPAVPDIRTDASVGDAAAAAGTSAVIAARKGSTSSSLTHRSNTGGANGNINLSTPSEVFVAPLSLSLQKLRLGDNRLGDDVFSVLSELTSLEVLNLSFNEIFEIPDFSLQTLTKLRELYISGNQLSTIPSDDLVVLQELRILHLNCNKLTTLPTELGKLKKLANLDVGNNVLKYNIANWHYDWNWNMNPELRYLNLSGNTRLEIKTKLSDMGFTRKSNISDFSRLTSLRMLGLMDVTMPLHSNATPDESDNRRVRTSLSQVNGMAYGIADALGKHDNLSVIDLVIPTFRKDEGECIFGLFDGRGHGAHVGSRIAHHLAEWSGHRLSWEFQKHQNEMTAEPVSVPDALRRAFLRLQKDYADALINDGSRKLSEAHAEAAADVTRSSAPAIAAASNKHDWRAGASAILAYVVDHTLYIANAGDALAVMSRNGGTAHLISNKHEPFDRAEIERIRSAEGWVSLRGYVNDMLDVSRSFGYFHLFPIVNAAPAVTTVQLTDSDEFVIIANRTLWQYVSYQTAVDIARTQRNDPMIAAQKLRDFAISYGAEESIMVMVISVGDLFYRSDQRNGGGLNFASYKNSDAIQKAGRRFREELPGDRTLARLDREVAPPIGQVALVFTDIKNSTSLWETNNGMQTAMRLHNYLLRRQLRTIGGYEVKTEGDAFMVSFPSVSAALLWCFTVQQQLLQEDWPREILDSEDGKEVYDQSGELIHRGLSVRMGIHWGRPVCEADPITRRMDYFGPMVNRAARISGAADGGQILASKDVIKELQGLLGTFDESSTAGGAGGEGENLEKTEEELDEDAFRLLNPNVSRDVVLLRRMGFGLSQLGERRLKGLETPEMLWLVYPKQLAGRLEQAKTDDAPDAPTAQVYEPTVQLLDIEDVKQVGMLCLRLEYLSNSTVCPGIFAAKDEADRSQPSTPLDDNGRNPIDGHGTAVPLLSHQARRKGVEAMLTMHPELLIYSIRDDATDEELAGILDQLTTRIQNAVSSLMLNMLRDKTANGTKELGVDPGVLELLMGLLSQPPPRASTSALSLPSPRTSPRNRLLELVP

SEQ ID NO: 242 - DNA, 6081 bp, Saccharomyces cerevisiae
atgtcatcaaaacctgatactggttcggaaatttctggccctcagcgacaggaagaacaagaacaacagatagagcagagctcacctacggaagcaaacgatagaagcattcatgatgaggtaccaaaagtcaagaagcgtcacgaacaaaatagtggtcacaaatcaagaaggaatagcgcatatagttattacagcccacggtcgctttctatgaccaaaagcagggagagtatcactccaaatggtatggatgatgtaagtatttcgaacgtggaacatccaaggccgacagaaccgaaaatcaaaaggggtccatatttactgaagaaaacattgagcagtctttcaatgacgagcgcgaatagtactcatgatgataataaagaccacggttacgctttgaattcatccaagacgcacaactacacatctactcataaccatcatgacggtcatcatgatcatcatcatgttcagttttttcccaataggaagccatcattagcggaaaccctattcaaaaggttttcagggtcaaacagtcacgatggcaataagtcaggaaaggaaagtaaagttgctaacctttccctttcaacggtaaatcctgcacctgctaataggaaaccttctaaagactccactttatctaatcacttggctgataacgtgccaagcactttacgaaggaaagtgtcctcattggtacgtggttcttccgtccatgatataaataatggtattgcagataaacagattagaccaaaggctgttgcgcaatcagaaaatacattacattcatccgatgttcccaatagcaaacgctcgcacagaaaaagctttctgctaggctccacatcttcttcaagcagtagaagaggttcaaatgtcagttcaatgactaacagtgacagtgcaagtatggcgacgtcgggtagtcatgttctccaacataacgtatctaatgtttctccaactactaaaagtaaggacagcgttaacagcgaatccgccgatcacactaataataaatccgagaaagtgactccagaatataatgagaacattccggaaaattctaactctgacaacaaacgcgaagccacaacgcctactatagaaacacccatttcatgtaaaccatcccttttcaggctagatacaaaccttgaggatgttactgatattacaaagacggtgccacccaccgctgtcaattctacactaaattctacacacgggactgagactgcctcacccaaaacggtgatcatgcctgaaggtcctaggaagtcggtgtcaatggctgatctctccgtcgctgccgcagcacctaatggtgaattcacatcaacttccaatgatagatcacaatgggtagcacctcaaagctgggatgtggaaaccaaaaggaaaaaaacaaaacctaaagggagatcgaaatcaagaaggtcaagtatagatgctgatgaacttgatcccatgtcaccggggccaccttcaaaaaaagactctcgtcatcatcacgatcgaaaggataacgaatcaatggtcactgcgggtgacagtaactcaagttttgttgatatatgtaaagaaaacgttccgaatgatagcaagaccgcactcgatactaaatctgtgaaccgcttaaaaagtaatttggctatgagtcccccaagtatacgatatgctccatcaaatttagatggggactacgacacgtcttccacttcctcatctttaccgtcctcatctattagttcagaagatacatcttcctgcagcgattcctcttcgtacactaacgcgtatatggaggccaaccgagagcaggataataaaacaccgatcctgaataaaacgaaatcgtataccaagaaatttacatcctcttcggtaaatatgaattcaccagatggtgcccagagttctggattattactacaagatgagaaggacgatgaggtcgagtgccaactggaacattactataaagatttcagtgatttagatccaaagaggcactatgctattcgtatattcaatactgatgacacttttacgactctctcatgtactccagcgactaccgtcgaagagataatacctgcacttaaaagaaaatttaacattacagcgcaagggaattttcaaatttccctgaaggtgggaaagttgtcaaaaattttgagaccaacttcgaaacctattttaattgaaagaaaacttttacttttgaatggttatcgaaagtcagacccacttcatattatgggtatagaggatttaagttttgtttttaagtttcttttccatcctgtcacaccttctcactttactcctgaacaagaacaaagaataatgagaagcgaatttgttcacgtagatttaaggaatatggatctgactacacctcccatcattttttaccagcatacgtcagaaatagaaagtttagacgtttctaataacgcaaatatattcctacctctggagttcattgaaagctcgattaaattattaagtttgagaatggttaatattagagcatctaaatttccttccaatatcactaaggcgtataaactagtatctttggaattacagagaaacttcataagaaaagtaccgaactcaatcatgaaactgagtaatttaacgatattaaaccttcaatgtaatgagcttgaaagcctaccggctggatttgttgaactgaaaaatctgcaattgctagacttgtcttcaaacaagttcatgcactacccagaagttattaactactgcaccaatcttttacaaatagacctatcatataataaaatccaaagcttaccacagtccactaagtacctagtaaagcttgcgaagatgaacctttctcataacaaactaaattttataggcgacttatcggaaatgacagatttgaggacgctgaacctaagatataacagaatatcatcaattaagacaaatgcgtctaacttgcagaacctttttttaacagataatagaatttcgaactttgaagacactttgccgaaactaagagcccttgaaattcaagagaatccaatcacttctatatccttcaaagatttttatccaaaaaacatgacaagtttgacgttgaacaaggcacagttatcgagtattcctggagaattactcaccaaactatctttcctcgagaaacttgaacttaatcagaataatttgactagactgccacaggagatatccaagttgactaaattagttttcctttcagtggcgagaaacaaactagagtatattccacccgagctatctcaactgaaaagtttgaggacattagatctacattctaacaacataagggactttgttgacggtatggaaaaccttgaactaacatcgctaaatatttcatcgaatgcattcggtaactctagcttagaaaattctttttaccataacatgtcatatgggtcaaagttatctaaaagcctgatgttttttattgctgcagacaatcaatttgatgatgctatgtggcctcttttcaattgctttgtcaatctgaaagtgctaaatctttcttacaacaatttttcagatgtatcgcacatgaaacttgagagcattaccgaattgtacctctccggtaataagctcacgacattgtcgggtgatacagttttgaaatggagctctttaaagactttaatgttgaatagtaaccaaatgttatctctgcctgcagaattatcaaatctctcacagctaagtgtatttgatgttggagcaaatcaattaaagtataatatatcaaactatcattacgattggaactggaggaataataaagaactaaaatatttgaatttttcaggaaatcgaaggtttgaaataaagtcatttataagtcacgatattgatgctgatttgtcagatctgacagtattacctcagttaaaggtactaggtttaatggacgtaactttaaatactaccaaagtaccggatgaaaatgtcaatttccgtttaaggacaactgcatcaataataaatgggatgcgctacggtgttgctgatacattaggtcaaagagactatgtgtcatctcgtgatgttacctttgaaagattccgcggaaatgacgacgaatgcttactatgtcttcatgatagtaaaaaccaaaatgcagattatggccacaatatatcaagaattgttagagatatttacgataaaatactgatcagacaactggaaaggtatggagacgaaacagatgataatataaaaactgcacttcgtttcagttttttgcaactgaataaggagattaacggaatgctaaattctgttgataatggtgccgatgttgccaatctttcatatgcagacttgctaagtggcgcttgctctactgtgatatatatcagagggaagaaactcttcgctgcaaatttaggtgactgtatggctattttatccaaaaacaatggtgactaccaaacgctaaccaaacaacatctcccaacaaagcgggaagaatacgagaggatcagaatatctggcgggtatgtcaacaatggaaaattagatggtgttgtagatgtgtctagagcagtgggtttttttgatttgcttccccacattcatgcttctcccgacatatctgtcgtgacattaacaaaagcagacgagatgcttattgtagcaacgcataagttatgggaatacatggacgtggatacagtttgtgatatcgcgcgtgagaatagtactgatccactccgtgccgcagctgagttgaaggatcatgccatggcttacggctgtacagagaatattacaattttgtgccttgctctttacgagaacattcagcaacaaaatcggttcactttaaataaaaactctttaatgactagaagaagtactttcgaggatactacattaagaagacttcaacctgagatttctccgccaacaggtaacctagcaatggtcttcactgatatcaaaagctcaaccttcttatgggagctattccctaacgcaatgaggaccgcaataaaaactcacaatgacattatgcgtcgtcaactacgaatttacggtggttacgaagtaaagacagaaggagacgcctttatggtggcatttcctacgccaactagtggtctgacatggtgcttaagtgttcaattaaaactcttggatgcacaatggccggaggaaattacctcagttcaagacggctgccaagttacggatagaaatggtaacattatctatcaaggcctatcagttagaatgggtattcattggggctgcccagttccagagcttgatttagtgactcaaagaatggactatttggggccgatggtcaataaggcagcaagggtccagggcgtcgctgacggtggtcagattgcaatgagtagtgatttttactctgaattcaacaagataatgaagtatcatgagcgagtagtgaagggcaaggaatctctcaaggaagtttatggtgaagaaattatcggagaggttcttgaaagagaaattgccatgctggaaagtattggttgggcattttttgactttggcgagcataagctaaagggactcgaaaccaaagaactcgttactattgcgtatcctaagattcttgcttccagacacgaatttgcatctgaagatgagcagtcaaaattaatcaatgaaacgatgttgtttcgtttaagagtcatttcaaacagactggaatctataatgtcagctttaagcggcggatttattgaactagactctcggacggagggaagttatattaaatttaaccctaaagttgaaaatggtattatgcaatcgatttctgagaaggatgcgttgttattttttgatcatgtaattactagaatcgaatccagtgtggcattattacatttacgacaacagaggtgttcaggactggaaatttgcagaaacgataaaacatctgctcgaagcaatattttcaatgttgttgacgaacttttacaaatggttaagaacgcaaaggatttatcaacttga

What is claimed is:

1. A recombinant yeast microorganism comprising a pyruvate utilizing biosynthetic pathway, wherein the pyruvate utilizing biosynthetic pathway is an isobutanol biosynthetic pathway comprising heterologous DNA molecules encoding polypeptides that catalyze the following substrate to product conversions:

a) pyruvate to acetolactate;
   b) acetolactate to 2,3-dihydroxyisovalerate;
   c) 2,3-dihydroxyisovalerate to α-ketoisovalerate;
   d) α-ketoisovalerate to isobutyraldehyde; and
   e) isobutyraldehyde to isobutanol; and wherein the recombinant yeast microorganism further comprises a first genetic modification, wherein the first genetic modification is a deletion or disruption in at least one endogenous gene encoding a pyruvate decarboxylase enzyme, wherein the deletion or disruption eliminates pyruvate decarboxylase activity, and wherein the recombinant yeast microorganism further comprises a second genetic modification, wherein the second genetic modification is a substitution mutation in an adenylate cyclase gene, wherein the substitution mutation is at a residue equivalent to A1814 or H1873 of SEQ ID NO:1 and wherein the adenylate cyclase gene encodes a polypeptide having at least 90% sequence identity to SEQ ID NO:1.

2. The microorganism of claim 1, wherein the pyruvate decarboxylase gene is PDC1, PDC5, PDC6, or combinations thereof.

3. The microorganism of claim 1, further comprising a deletion, disruption, or mutation in a gene that regulates adenylate cyclase activity.

4. The microorganism of claim 3, wherein the gene is GPR1, GPA2, RAS1, RAS2, or combinations thereof.

5. The microorganism of claim 1 comprising:
   a. at least one gene encoding an adenylate cyclase comprising the amino acid sequence of SEQ ID NO: 2;
   b. at least one gene encoding an adenylate cyclase comprising the amino acid sequence of SEQ ID NO:3; or
   c. both a) and b).

6. The microorganism of claim 1 which further comprises a mutation in a gene selected from the group consisting of FLO9, NUM1, PAU10, YGR109W-B, HSP32, ATG13, and combinations thereof.

7. The microorganism of claim 1, wherein the microorganism is a member of a genus selected from the group consisting of *Saccharomyces, Schizosaccharomyces, Hansenula, Candida, Kluyveromyces, Yarrowia, Issatchenkia*, and *Pichia*.

8. The microorganism of claim 1, wherein the microorganism has an increased biomass yield as compared to a corresponding microorganism that does not have the substitution mutation in the adenylate cyclase gene, wherein the substitution mutation is at a residue equivalent to A1814 or H1873 of SEQ ID NO:1 and wherein the adenylate cyclase gene encodes a polypeptide having at least 90% sequence identity to SEQ ID NO:1.

9. The microorganism of claim 1, wherein carbon flow through the pyruvate utilizing pathway is not reduced compared to a corresponding microorganism that does not have the substitution mutation in the adenylate cyclase gene, wherein the substitution mutation is at a residue equivalent to A1814 or H1873 of SEQ ID NO:1 and wherein the adenylate cyclase gene encodes a polypeptide having at least 90% sequence identity to SEQ ID NO:1.

10. A method of producing a fermentation product from a pyruvate utilizing biosynthetic pathway, wherein the pyruvate utilizing biosynthetic pathway is an isobutanol biosynthetic pathway, comprising:
    a. providing the microorganism according to claim 1; and
    b. growing the microorganism under conditions whereby isobutanol is produced from pyruvate.

11. The method of claim 10, further comprising (c) recovering the isobutanol.

12. The method of claim 11 further comprising (d) removing solids from the fermentation medium.

* * * * *